US007696410B1

(12) United States Patent
Bhattacharyya

(10) Patent No.: US 7,696,410 B1
(45) Date of Patent: Apr. 13, 2010

(54) ***RPS-1*-κ NUCLEOTIDE SEQUENCE AND PROTEINS**

(75) Inventor: Madan K. Bhattacharyya, Ames, IA (US)

(73) Assignee: Iowa State University Research Foundation, Inc., Ames, IA (US)

( * ) Notice: Subject to any disclaimer, the term of this patent is extended or adjusted under 35 U.S.C. 154(b) by 187 days.

(21) Appl. No.: 11/805,792

(22) Filed: May 24, 2007

Related U.S. Application Data

(63) Continuation-in-part of application No. 10/909,950, filed on Aug. 2, 2004, now Pat. No. 7,256,323.

(60) Provisional application No. 60/492,169, filed on Aug. 1, 2003.

(51) Int. Cl.
*C12N 15/09* (2006.01)
*C12N 15/82* (2006.01)
*C12N 15/29* (2006.01)
*A01H 5/00* (2006.01)

(52) U.S. Cl. ........................ 800/279; 800/278; 800/298; 800/312; 800/317; 536/23.6; 435/468; 435/419; 435/320.1

(58) Field of Classification Search ........................ None
See application file for complete search history.

(56) References Cited

U.S. PATENT DOCUMENTS 7,148,397 B2 12/2006 Osumi et al.

OTHER PUBLICATIONS

Lazar et al., "Transforming Growth Factor a: Mutation of Aspartic Acid 47 and Leucine 48 Results in Different Biological Activities", Mol. Cell. Biol. 8:1247-1252 (1988).
Parker, Jane. E., et al., "Characterization of eds1, a Mutation in *Arabidopsis* Suppressing Resistance to *Peronospora parasitica* Specified by Several Different RPP Genes", The Plant Cell, 8:2033-2046 (1996).

*Primary Examiner*—Medina A Ibrahim
(74) *Attorney, Agent, or Firm*—McKee, Voorhees & Sease, P.L.C.

(57) ABSTRACT

This invention relates to the purified and isolated family of Rps1-k disease resistance genes, proteins encoded thereby and use of the same to confer, enhance or otherwise modify resistance of soybean to plant pathogens, particularly *Phytophthora sojae.*

13 Claims, 81 Drawing Sheets

```
                    1111111111111111111111111111111
               577883333334444444455555555556666666
               139042345691235678901234567890123456
Rpsl-k-1  CTATATAATAAAAAAATAAAAATAAAAAAGACCATA
Rpsl-k-3  ....................................
Rpsl-k-5  ....................................
Rpsl-k-2  TC--G-----TCCTGC--------------------
Rpsl-k-4  TC--G-----TCCTGC--------------------

                                          1111111111111111111111111111111111111111111111111111111
                1223333456666777778888999999000000000011122244444444444445566677788888899999999999
           3457922202669302280122935661123390113337799345479022223334445957148005111225124555555 69
          6022855191536179594643438912281399907012243841252042789012479004651345626745711903457990
Rpsl-k-1  TTCCCTGCGACCAGTTGAGCTTCCACATGCCGAGTTG---GTCCGTGGCTATATAGAATGTGATAGTCTGTTCATGATTAGACGGAGA
Rpsl-k-2  ACTGGGAACGAATAACCTCGGGGTCACCAATTCAACTGCAACGGTACAAAGA------CCCACCGACTAACCTTAAGCCGTTGCTTAG
Rpsl-k-3  ........................................................................................
Rpsl-k-4  ACTGGGAACGAATAACCTCGGGGTCACCAATTCAACTGCAACGGTACAAAGA------CCCACCGACTAACCTTAAGCCGTTGCTTAG
Rpsl-k-5  ........................................................................................

          2222222222222222222222222222222222222222222222222233333333333333333333333333333333333333
          0000001111122222233444444445555555666666677888899990000000001111111111111111111111111111
          0459990378902778946122267892233889556667838123733336666677790000011111111112222222222333
          5120156890426899368723465171702791472346715502723891678934855678901234567890123456789012
Rpsl-k-1  CAGGAACCTGATAAGCAGGTAAGTCTCGCCAGATACACATGCAAGACTATCGTGAAAGCC----------------------------
Rpsl-k-2  TGAAGGGTCAGCTGATGTCAGGACTATTGGCACGCAGTGCTTGGCTTAGAATCAGCGAGATTCAGGGGCAGAGTCATTTAAGAGTCTG
Rpsl-k-3  ........................................................................................
Rpsl-k-4  TGAAGGGTCAGCTGATGTCAGGACTATTGGCACGCAGTGCTTGGCTTAGAATCAGCGAGATTCAGGGGCAGAGTCATTTAAGAGTCTG
Rpsl-k-5  ........................................................................................

          333333333333333333333333333333333333333333333333333333333333333333333333333333333333333
          111111111111111111111111111111111111222222223333334444555555555555555566666666666666677
          333333444444444455555555556666666661111888891555682469000111777888899901122255555578814
          345678901234567890123456789012345674569349083894870873892367892345456312189123567 04620
Rpsl-k-1  -----------------------------------CAAGCGCTGTTGTATGGAAAGGACACCAGACTTTATGGGAAAAAGTAGAAA
Rpsl-k-2  TGTTATTTGTTAATTTACAAATGCCCCAACTTTGTAGTTGAACCGGAGGACACCTAACGCAATTTTAAAGCTTTTGGTGAAGCTGG
Rpsl-k-3  .......................................................................................
Rpsl-k-4  TGTTATTTGTTAATTTACAAATGCCCCAACTTTGTAGTTGAACCGGAGGACACCTAACGCAATTTTAAAGCTTTTGGTGAAGCTGG
Rpsl-k-5  .......................................................................................

                                1111111111111111111111111111111111111111111111111111111222222
               234555666677899999900000000001111111222223334444455666777778888889999999000000
          58507023002618716899990000000002000444442466856811599020270111781456780023455504 5678
          395285827888732471378901234567825892345619029836342375986411498147522809452134269678
Rpsl-k-5  GCTACATACTGCT-TTATCTGAAATATATCAGT--AAAAATTTTAGCC--TAAGAACTGAGTATAGATAACTCGTGTAGTCGAA
Rpsl-k-1  ....................................................................................
Rpsl-k-3  ....TGCGTCAACT-C-CT-----------AAAAG---.GCACTATTTTAGG-CCTCAGACGCGAGCCG.GGACACGCCGAGG
Rpsl-k-2  TACGTGCGTCAACT-C-CT-----------AAAAG---.GCACTATTTTAGG-CCTCAGACGCGAGCCG-GGACACGCCGAGG
Rpsl-k-4  TACGTGCGTCAACT-C-CT-----------AAAAG.---GCACTATTTTAGG-CCTCAGACGCGAGCCG.GGACACGCCGAGG
```

FIGURE 8

A MAAALVGGAFLSAFLDVVFDRLASPEFVDLIR

B GKKLSKKLLQKLETTLRVVGAVLDDAEKKQITNTNVKHWLNDLKHAVYEADDLLDHVFTKAATQNKVRDLFSRFSDRKIV
SKLEDIVVTLESHLKLKESLDLKESAVENLSW

C KAPSTSLEDGSHIYGREKDKEAIIKLLSEDNSDGREVSVVPIVGMGGVGKTTLAQLVYNDENLKQIFDFDFKAWVCVSQE
P loop
FDVLKVTKTIIEAVTGKACKLNDLNLLHLELMDKLKDKKFLIVLDDVWTEDYVDWRLLKKPFNRGIIRRSKILLTTRSEK
Kinase-2
TASVVQTVHTYHLNQLSNEDCWSVFANHACLSTESNENTATLEKIGKEIVKKCNGLPLAAESLGGMLRRKHDIGDWNNIL
Kinase-3a
NSDIWELSESECKVIPALRLSYHYLPPHLKRCFVYCSLYPQDYEFEKNELILLWMAEDLLKKPRKGRTLEEVGHEYFDDL
VSRSFFQRS--RTSSWPHRKCFVMHDLMHDLATS

D LGGDFYFRSEELGKETKINTKTRHLSFAKFNSSVLDNFDVIGRAKFLRTFLSIINFEAAPFNNEEAQCIIMSKLM

E

| | | |
|---|---|---|
| | xxLxLxx | |
| YL | RVLSFCD | FQSLDSLPDSIGKLI |
| HL | RYLDLSF | SRIET**LPKSLCNLY** |
| **NL** | **QTLKLCS** | **CRKL**TKLPSDMRNLV |
| NL | RHLGIAY | TPIKEMPRGMGKLN |
| HL | QHLDFFV | VGKHEENGIKELGGLS |
| NL | RGQLEIRK | LENVSQSDEALEARMMDKK |
| HI | NSLQLEW | SGCNNNSTNFQLEIDVLCKLQPHF |
| NI | ESLEIKG | YEGTRFPDWMGNSSYC |
| NM | ISLKLRD | CHNCSMLPSLGQLP |
| SL | KDLGIAR | LNRLKTIDAGFYKNEECRSGTSFP |
| SL | ESLSIDD | MPCWEVWSSFDSEAFP |
| VL | NSLEIRD | CPKLEGSLPNHLP |
| AL | TKLVIRN | CELLVSSLPTAP |
| AI | QSLEICK | SNKVALHAFPL |
| LV | ETIEVEG | SPMVESVIEAITNIQPT |
| CL | RSLTLRD | CSSAVSFPGGRLPE |
| SL | KSLSIKD | LKKLEFPTQHKHE |
| LL | ETLSIES | SCDSLTSLPLVTFP |
| NL | RYLSIEK | CENMEYLLVSGAESFK |
| SL | CYLLIYK | CPNFVSFWREGLPAP |
| NL | ITFSVWG | SDKLKSLPDEMSTLLP |
| KL | EDLTISN | CPEIESFPKRGMPP |
| NL | RRVEIVN | CEKLLSGLAWPSMG |
| ML | THLNVGG | PCDGIKSFPKEGLLPP |
| SL | TSLSLYD | LSNLEMLDCTGLLHLT |
| SL | QQLQIFG | CPKLENMAGESLPF |
| SL | IKLTMVE | CPLLEKRCRMKHPQ |

E IWPKVSHIPGIKVGNRWI

```
aaagctccatcaacatctctggaagatggatctcatatatatggtagg
 K  A  P  S  T  S  L  E  D  G  S  H  I  Y  G  R
gagaaagataaggaggccataatcaagttgttgtcggaggataacagtgacggtagagaa
 E  K  D  K  E  A  I  I  K  L  L  S  E  D  N  S  D  G  R  E
gtgtctgtggttcctattgtgggcatgggtggggttggaaaaactactttggcccaattg
 V  S  V  V  P  I  V  G  M  G  G  V  G  K  T  T  L  A  Q  L
gtgtacaacgatgagaatttgaaacagatatttgattttgattttaaggcatgggtttgt
 V  Y  N  D  E  N  L  K  Q  I  F  D  F  D  F  K  A  W  V  C
gtttctcaagaatttgatgttctcaaggtcacaaaaactataatagaggcggtgactgga
 V  S  Q  E  F  D  V  L  K  V  T  K  T  I  I  E  A  V  T  G
aaggcttgtaaattgaatgatctgaatctacttcatcttgaattgatggacaagctgaaa
 K  A  C  K  L  N  D  L  N  L  L  H  L  E  L  M  D  K  L  K
gataaaaaattcttaattgttttggatgatgtttggacagaggattatgttgattggcgt
 D  K  K  F  L  I  V  L  D  D  V  W  T  E  D  Y  V  D  W  R
cttcttaagaaaccatttaaccgtgggattattaggagaagtaaaattcttctaacaacc
 L  L  K  K  P  F  N  R  G  I  I  R  R  S  K  I  L  L  T  T
cgcagtgaaaaaacagcatctgtagtccaaactgttcacacctatcatctaaaccaattg
 R  S  E  K  T  A  S  V  V  Q  T  V  H  T  Y  H  L  N  Q  L
tcgaatgaagattgttggtcagtgtttgcgaaccatgcatgtctttccacggaatctaac
 S  N  E  D  C  W  S  V  F  A  N  H  A  C  L  S  T  E  S  N
gagaacacagcaacactagaaaaaattggaaaggagattgttaaaaagtgcaacggactg
 E  N  T  A  T  L  E  K  I  G  K  E  I  V  K  K  C  N  G  L
cctttagcagcagagtcgcttggaggcatgttgagaagaaagcatgacattggtgattgg
 P  L  A  A  E  S  L  G  G  M  L  R  R  K  H  D  I  G  D  W
aataatattctcaatagtgacatttgggaactttctgaaagtgagtgtaaagttattcca
 N  N  I  L  N  S  D  I  W  E  L  S  E  S  E  C  K  V  I  P
gcactgagacttagttatcattatctccctccacatttaaaacgatgctttgtttattgt
 A  L  R  L  S  Y  H  Y  L  P  P  H  L  K  R  C  F  V  Y  C
tcgttgtatccacaagattacgaatttgaaaaaaatgaattaatcttgttgtggatggct
 S  L  Y  P  Q  D  Y  E  F  E  K  N  E  L  I  L  L  W  M  A
gaagatcttttgaagaaaccaaggaaaggtaggactttagaagaggttggtcatgagtat
 E  D  L  L  K  K  P  R  K  G  R  T  L  E  E  V  G  H  E  Y
tttgatgatttggtttcgagatcgtttttccaacgttcaagaacaagtagttggcctcat
 F  D  D  L  V  S  R  S  F  F  Q  R  S  R  T  S  S  W  P  H
cgcaaatgttttgtgatgcatgacctcatgcatgatctagccacatca
 R  K  C  F  V  M  H  D  L  M  H  D  L  A  T  S   FI
```

FIGURE 26A

```
>Rps1-k Contig
ATTTAGGTGACACTATAGAATACTCAAGCTTTACAATCGGACAAACTGGT
TACTATACAACTACTATGTTTTTCTTTTCTTTTCTTTTAATCTCTGTTC
CCATTTTATCACAAGTATTTCTTTTTTGTCATTTATTAAAAAAAAGTAAG
GAAAATTAATACTGTAAATTATAAACACATGCCATATAAAATTGTGTAAA
AAAAAAATAAACGCATGCCATATAAAAACACATGTCATAAACAACGTTTT
AAATTGTGGTCTCTGGTCAGCAGCCACAATTAAAATTCGGCGACCCAATT
TTACCTACGACAACTTCAAGTCTTCCACTACTTACCACACAATTTAAAAA
ATAAATAATAAAAAAAAACATAAAAGCGTGTAAACGCCACTACACTGAAA
TTCAGCAAAAAAAAAAAAAAATCAGCAAAAAAAGCCACTACACTAACTTT
AGAAAATTGGAAGGAAAAAAAGGTATCCACAAGCCAAAACTTAGATTAAG
AAATAACTAAATTAAATACTTCAAAGTAAAAACATTAAAAAAAACCCCAA
AACAGCAAATAATTAACAATAACAAAGCAACAAATCACAAAATTACTCCA
AAGTTCTAATCAACTGTTGTGTTCCGTGCATCCACGTATCAAACTCACGC
GTCAATTTCAACACACGCTCATCGATTCGAAATCTAGAGCATCATTACCC
GCACTTATCGCAGAGATCGGCGAATTCGCCGGATCGCAGGGCCCAGCCTT
TGCGCCACCGAATCGTCGTCGAGGTGGCGCACGCCACGTTCATGCAGCTC
CTTGACTCCATTTTCAACTCCAATTCCACACAGACTCTGCAAAAAAAAAA
ATCAGAAAAATCAGAACGAAAAACCCTAACTGTCACCTCACCGACTCGCG
CGACGCCGGATGTAAAATCCGGCTGCGGAGAAGCGCCCGTACCGAAATTA
AGCGGGAGAGCGAAGCTCGAGTGGTTCCTCCGGTCGCCGGAAGTTCACGA
GGGGAAGTTCCGGTCACCGGAAGTTAATTTTTAAGCGGAGGAGGTGCCGC
GAGGGGTGAGGTTTGGGATTCGCATTCGCGCGTTGTGGAGAGGAATAATG
AAGTGTGATCGGAAGATTGTCGGAATCTGAACGGAGAGAAACCGGAGAGA
GATTTGAATGGACGATGGTAACCGGAGAGAGAGAGAGAAGAGAGGGGTGA
AACTGAGAGAAAGAGAGAGAGAGAGGAGGCGTGTGCATGCAGAATATAAG
AAAGAAGAAAGACAGCACCAAAATGCATGCACGATGATTATACTTCAAGA
CTCGGCCAACTCCCCCACTTGCTCCCTCTTTTTTTAATTTTTAATTTATC
ATCATTATTATTATTCTTTTTGTAGCTTTTATTATTAGCAATATCATTGT
GGTTGTATTGTTACTCATTATTTTATCTTGTTTCTTTTTTGGCTAGATAA
TGTTTAGTATTAATTAAATATTAAATATATGTTAACATTTTTTAGATAGT
AATGTATGAATAAAATTTGTTGATATTTAATGTGTGAAAATACAAATATT
TTAAATGTTAAATTATGAATAAGAATAAAATTTTCTTACATTCTTAAATG
AGAATAATTTTTTAGATAGTTAAATTATGTTTTAGTCCTTAGACAAAAAT
TTTAGCATTTTTTTGTCTTTATATTATTCTTTGTTAAAAAATTTAGTTTT
CTTTTTTAAGTCGTAGCATTAATTGATGGCGTGACTCTGTTAATGATAAA
TTATTTGATTATATGTTGGACTGTCTTGGATTTGATAGTGCTTGGAGAAA
GTGGATTAAAGCAACTTGCTTAAGTTGTATGTCTACTTTGGTCAATGGTA
GTCTAATAATGGAGTTTCTGGATGAAAGTGGTCTAAACAAGGTGATTCTT
TGGTGTCTTTTTGTCCCTTATAATGGTTAAGGGATTGAATGACTTAGTTA
GTAAATTTGTGGAGGCAGGTAGGGGTTAAAGGCTTTGAAGTTTATGACTT
TATTTCCTTTTCTTTAATACAATACACAAATGATTTGATGATGTTTGGTG
AGGCATATTGGGACAACTTGTGGGCTCTTAAAGCCATTCCACGAATCTTT
GAGCCTGTCTCTGGTTTGAAGGTGTACTGTCCAGGGTTCACGAGTGACAT
GGCGAGTGATGCAGCATTGAGTAGTCCTTATTAGCCCTCCATCTTGGTCA
GCCCTAGACCATGAACACAGATGTTCTCTAGAAGGTCAACCTTAGCGCCA
CATGGCTAAGTAGTTAGGTCATTATGATATTTCGATACGCGAGTATCTGG
CTGTCAAGGTAGTTACAAAGTTGTTGCAATGCGGTTACACCTGACTAATG
AGGTTGTTATGATGTTGCAACAACCTCTCAGGCAACACCCTAGGATTTTC
ACCAATCACTATAAATAATCAGGTTCTATATTCACTTTAACTTAACCTTT
TACTCCCTCCTCATTCCTCAGGCAGAGGATACTGACAGATTCACCACCAC
GAAGATCACTAGAGTACCCACACTAACGACGGACAACTCTGATGTTAGTC
TGGCTCCAATTTTTGGCAAGTACAAAAGGTAAACTCTCTTAAAAGCAAAA
TATATGGTGTTAATGAGCATGATAATTTTATGGTTATGGCATCAACATTT
CTTCATTGTTCGACTGCAACGTTGCCTTTTATATTCCTTGGAATAGTCAT
TGGTGCTAATCCCGAGTGAGCTACCACATATGATCCAACTTTTAGCTTAT
TTAAGAAAAAGTTGTTTCAGTGGAAAAGGCGTTATTTGTCTTTAGGGGGA
GGCTTACTTTGTTGAATTCGATGTTGTTATGTTTTCCTTTATATTATTTC
TCTTGTTATAAAGCCCCAAAGACACGATGTAGCTCCATGTTGAGCTTGTA
GGCCTTGGATCTTCCTATCAATGGAGTCCTTTGTTTCTTTAAGATCAATG
GTAGCGAAATGGAGAAGAAGAAAAATGATTGGAGACGTCACTTTAAGGAG
AAGATGAGTCAAGAACAAGCTCATCACTATAGGAAGCCATGGATAAGAGT
TTGAAGGTAGAAGAAGATGAGTGGAGGGAGAAGGAGAGAAGGAGCACGAA
ATTCTGTGCCTCAAATGAGGTCTGAACTTTGAACATGAGTAGATAAAATT
ACAAAGATGGTGTATGTGGAGTGGTTTTTTGGAGACAAAGAAGATATGTT
GGGTTAATTGGGAAGCAGCAAGTCTCCCTAAGTTAAAAGTCGTTTTAGAG
TGAAAAATTTGAAGTTGTTTAATATCAGTCTTCTAGTTTAATGGAGGTGG
CAAATTGTGTCTGATAAAGATGCAATATGGTATAATTTGCTTTGTTTTAA
ATATGAGAGATTGAATTCAAATTCTAGTAGTAATAATTCAGTCAGAAATA
CATCTAATGAGTGGAAGGATGTTATGAGTTTAGACAAATGATTGTTGGTT
```

FIGURE 26B

TCTTAATTTAGTTACTCAAAGTGTAGGAAATGGCTTAAGGATCTTGTTTT
GGAAAGATAAATGGTTAGGTGATACTTGTTTAATGGCTTTTTTTTTCGTC
ATCTTTATCACATCTATCTTACACAAGATAACGTAATGGTGGATATGGGT
GTATGGACATCATTTGGATGGCAGTGTTGTTGGAAATGGAGATGTAGGTT
GTTCTGTTGGGAGGAAGAATTGAATGACTAGCTGATGCAAACTTTGTTTG
GTGTTACCTTGGCCAAGGACAATCAAGATTCTTGGGTATAGAGTCATGGT
GGCTCTCAACAATTCTCAGTAGCAACTGCATATGCTATTTTACTCTTGAT
GTAATAGTAAACAAAGATTTCCTAGGATTTCTATCGAAGAATTTTTGGAA
GTGTGTGTCCCTTTCCAACATGTCTTTTTAAGGAGGCTCTTACGAGATTG
GTTGCTAACTCAGGTGGCTTTACCTCACAGAGGAGTTGCAAACGATGGTA
CTAGTTGTGTTGTGCTTACAATTTGTGGAGACCACGAATCACTTGATCTT
CCAAAATCACTTTTCTTACCAAGTATGGATATGTGTGTATCAATGGTTGG
CATTTTGTCAGGCTCAACACAATCAGATGCAACAACATTATGTTCAACGT
AGGTTGTTGTTTAGGGGGGAAAGAAAATGTGTCAATTTTGGTATATAGTT
TGGTATGCTACATGCTGGTGTATATGGTTGTAGAGGAACAATTTTCACAA
TGTCATTTTAGTGGACCTAGTTTAGGTGTAAGGAGTTTATTTTAGTGGTA
TTTCTTTTGCCAACAACTATTCTTGTTCTATGGAATGTCTTAAAGATTTT
GTATAATTTTGCATTCTTGGTAGGATAGTAAGTCTTTGCTAGTCTATAAT
ATGATGTCTCTATTACATGGTTATATATTTCATATCCTCTTAATAATATT
CAATTTTATGTTGAAAAAATTGACAACCTGACATTTACATTGTTAGTTAC
ATAACTTGTCACCTTATTGATGATTTTGATATAGAAAAATATGTGTAATT
TTTTTTATAAATTATATTTTTAGTCCTGTGTGTTGTTAAAATAATTAGTG
GTATTAGACTAATTGATAAAAGATTAAAAATATAATTTGTCAAAAAATAA
AATTTCATAAGTAATTATTACATTAGACTAATTAATAACAATGAAAGTCA
CACATAACTGTTATTTCATCGGTTATGGGTGATACTTGATAATTGAGACT
AAAATTGTTGATAAAAAAAATAAAAGGGGTAAAAAGCTAAAAAAAAAATT
GTTTCGAAACTAAAAGTGAACTTTACAAAAAATTTAGGGACAGAAAAAAC
CCTGTATCCTTTATAATCAACTAAGAGATAGATTTTCTTATTAAATAACT
AACTGTAATAAAATTAAACAATTAATAAATTTATTTTACAAAATTTATTT
TAAAAATAGGATTCTAAGACAAATAGTATAATTTATTTAATTAAAAATAA
AAAAGTTCCGTATGTCGTATACGAGAAAGGAAGGGTTGGTATTTTATTTT
TATATATAAAATTATTAATATTTTAAAAAAACATGTTCACTAGTTTCTTT
ATTTAAAATTATAAATATCTGTCACTTGTTCATTTCAAGCTCTTCTCTTT
AAATAAAATAAATTCTATTATATATATTGAAACATATGACTTTTTTTAAC
AGAAGTTTTAAAAAATATGACTTAAAAAATGAGAACACAGTTTTGTTTAC
TTTATATATATTGAACATCAAACATTTGAATATGATCGACTTTCATAATA
ATAAACAGTAACATATTTTTTCTCACTCTTTATTTTATTTTTTATTTTTA
TTTTTATTTTTGAAAAAATCAAATAGAAAGTTATTAATTAATTCTAATGT
TTTATTAATACGTTTTTTTTATCTTTATATACTTTTTTAATTTTTAAACT
GTATTTAAGTAATAAAAGAATTTCTTGACATGATAAAAGCTTGATTTTTT
TCTTGATGATACTATTCACATGACCTTTTTATAAACAATATATAATAAAC
AAATAATTAATATATTTCCTTATCTTTTGAATGCTATTTATTTTATAAAA
TAAAATCTTTAGTATTTATTTTTAAATTTTTTAAATATTAATAAAATGTG
AAAAATACCTATAAATTATACACGAGTTAAAATATTAATTATCAAAAGCA
TTAAAGTAATTTTCTCATTCTCTATCGTATCACTTTATAGTAGTATTTTT
TTTTCTTTCAAATTTCTTCTTTTTAATGTTTTCATGCACCCTATTTTGGT
ATTTTAGGTTGAACGTTATCAGTACCCATATTAAAAAATTCATCAAAAAA
AGTACCCAAATTAAAATATCCAAAAGAACAGATAAATACGCAGAAATATA
GCGTATAATGGAAAATGCGACCGCTAGCACCGGAAAATGCGCCACTTAGA
TACAGTTATTTTGATGAATTTACTATAGTATCCTTTGTTAGCCACAACGT
AGGAGCACGTATTCACCCGTCAAGAGGTTTGCCCTTTTTCGTCCAATTTC
GATTTCTATGTGGACCCAATTAAATATTGGTCAACCTTCCGAACATTGAA
GTATAAATAATATTCATCTTTATCTTTTATCTGTATCCGTACTATATCTA
TATTTATATTACACTGTAAACACAGATAACAAGAATATTACAATATATGC
TAGTAAAATCATGTAGTTATAATACTTTTCCTCCAAAATCTATGCTTTTT
ACATAAGTTGTGTAATAAAACATTTAATTATTTTTTTTACAGGTTGTACT
TGTGAAACTAAAATGAAAAGTAAAAATCCTTGTTATAAATAATTTAATTT
ATACATGTGATAAAATAAAATGATTTTTATTTAATAATAAATCAGCTACT
AACTTTTTTTGTATAAAATTAATTCAAACATATGTTATGTTAATCAATAA
ATATATTTTTTTAGTTTTTTTATATTTCGATAATAAATTTCTAATTGTAT
GATTATCACATACATAATAATACGCCAATTTTTTTATACGTGTAATAATA
TACATCATAAGTTTAATCAATGCTCATTATTGTAAAATATTTTGATAGAA
ATATTCAATAGGGTTTAATTATTTTATCACATCAATTTTGTAGAGGAAAT
TTATCCCATCATCATCTTAATAATTATTATAATCTAGCGATAAAATGATT
TTGTACAAAACATATAAAAATATTTTACAATAAGTGAGTGTACAAGTTAC
TAAACAAGTGTGTCTACATATTAAACTCCAATAACAAAGCAATTAAAATT
TAATATTTAGATAATAATACGGAAAAACATTTTACATTAAGTGCGTCTAC
AAATTAAACACAAATAACATAGCAATGAAAAAAATAATATTTACATAATA
GTAGTAATTCGGAAAAACATTTTTATATTAGTATTAAAAGCTTTGACAGT
TATAACTGTTACTTAAACCTTAAAAGCTTCAACTAATATTTTCTTTTAAC

FIGURE 26C

AGAGTTTCAACTAATGTGTTTGGTTGGAAAACTTAATTACTAGTATTATG
GTTTTTTTTTAGTTGGAAGCACGTTTTTCAGTTGAGTAAGTAGAAGTTAT
TATGACGTGAGTGTGTTGTGTGATGACGAGGGTGACGCAAAAGTAAAGGA
ATCACGTCGAGTCGACAGGTAAAAGACAATGACAGAGCCATCTCCATCTG
AGTTAGTGCCAATCGCACGCGTGATTGCTGTGCCTGGATTTAAAATATAA
AATACATTTAAATCTATCTTTTATTATTTAAATATTTTTATGTTTAAATA
TTTGTACATTATCTTATGATATATTTATTTATCAAAATAAATTTGCAAAC
TAGTATGTTAATTTTTGTTGTATCTTATTTTAAGTTAACATAAATTTTTT
AACTTAAGATAAATTTAAAAATACACAGAGATAGTATTCGAATACAGTTT
ACTATTTGCGCATGACCTAACATTACGTATGGATTATGTAATACGCAACC
AAAAATATCTCGCGGATTTTATCGGTTGATCTTTGTTCAAATTGGCGATG
GCCGAAAGTGTTATCTTCAACATCCTTATAATGATTATGATAATCAAAAG
ACATTTTATTTTGTTATAATTCATTAATGATAGACATTAAATATGATTTA
AATTTAATTCTAAATCTTTATATATATATATATATATATATATATATATA
TATATATATATATTATTTTTTTAGTTGTGATTCAGTTTTAATATTTTATT
ATCAATAACCATGAAATAATGTTATAGAAGATGATATATTTATTCACAGT
TTCATATTAATAAAAATTATATTTCTATTTTCTTAACATATTTATCTTGT
TGATACTATTTAATTTCTATTGATCGTCAATAAATTTATTTATTTTTCTT
TCTCGCATGATTGTGTTATTTGTGACCTTAAAGCATAATATGGAGATAGA
ATTAATCAACATAAGTCATTTGATAATATAAGTTAAGTTTATGGATTAGA
ATTTGAGTTTGATTTTTGTAAAATACATTCTTTTTGAAAAAAATAATAAT
TTTTAAGTATAATTAAGTCTCACTTCTAATTGAAAATTAATCTTATAATT
AATTCAAATAATCAAAGTTTATGAACATACATTAGAATATTATTGGGAAC
CTAAGATCCTAATTGCATATGGTGATACTAAATAAAAAAAATGTACATAC
TTCTTAAATTCAACGCTGATACATTAAAAAAAATCAACACTAGATAAAAT
TTTGAGTAAGACTTTTTCTACCAGGAGACATATGATTTTTATTAAGTTTT
TATGTGTAAAAATTTGACTTAATTATACTTATTTTCTCATGTATCATTAT
AATATAATTTTATTCTCTAATTAATTGAGTCTCCTGAATATTATAAGTGT
GAGATTTTAATCCTTTTGATAGTTGGCGGCATTGATTGATATGGTATTGG
CATTAAACTGAGATAGTGATTAATTTGGCATCTTATTTGATTTTTAATTT
GACTTGTTTGATTTTAGTCCTTGGGAGTTTTATAATCATGTCATTTTAGT
TTTTTTGTATTGCATAATGATAGAATTTTAGTTTTTTAAAGTGATGTAGA
CTAAAATGATGAAAACATTCATAAAATGTTATAGTTTGATTCAATCCCAT
GTCACACATTAATAGTGTTTATTAAACCACTATACCTATAACATTTTTTT
ATTATAGGTATACCTAAGCCTAAATAACTAAAATTATAATATATAAGTTA
AATACAATAATATTAATAATATCATTTTTATAGGTGACTTTAAGCAATTA
ATTATACTATTCATTCGTTAACTATTTTCTTAATTAATTATTTTATAATA
TTTAAATACATATTTTCCACTTTACTAATAACACTGTTTAGTTTTTTTTT
AATACGGCTTTGTACTCTCATATGCTATTGAATCGGGAAAAACACAATAC
AAATTAAGTTAATTTATGCAAAACAATTTTTTTACGAGATTATGTAGGAA
ATATTATAAAATTTCTATGAATATTTTGATGAGCTTAAGAAAATTAACAA
AACCAATGTTAATTAATTAATTTCTACCAGGAAAAAAAAAAGGCAGAAGC
CAATGAAATTTAAGGGGTACAGCAAAGATTTGTAGAACCATCATTAATAT
TAGTGCAACATACCATGATGAAGTGCATGACATAATAATAATGTGGAGCC
AATTGTGATAAGAACAGAAAATAAATTAGTGTAATTGCATGATCAGAATA
AAGAGAAGATATATCATGTTCATATTGATCAGAAAATAAGGCAACATGTT
AAAGAAATGTGCCAGGTGCAACAATGAGGGAACAAAAAAGAGAAGGATAA
TAAAGAATGTGGTTATGACTTTTACAAAATCGAATTATTTACTTTTTTAA
TTTTTTATATTTTCCTTTTTACTTTCCTAATAGTTGTCCGATTAAGAGGA
ATTTATGGAGTAGATTAGATTGATTTTGAAAAAGAGAAATATCATCTTAT
ACAATTTTTGGTTTTTTTAATTCATTGTTCAATTGATGTAGTTTAAAATT
TAAATATGATTTAATCAGTCTAGATTGATCTCAATTTTAAGTTTTAATTT
TATTTCTATTTTTTTAAAAAATAAATATTTAAGATATATAATAATTGTGA
TACAAAGTAATTTAAAATATTTCTCCAAAAAATGTAATTTAAAATATCAC
ATATATATAAATCATTTTAAAGCTAATAGTAATATTTCTATAAAAAAAGC
TAAAAGTATATCTCTGTTATATAAGTTGATAATTATATTTATATATACTT
GAATAGTTACTGAATATTATAATTAATTAAATTTACTTTTCATAAATAAT
TTTAAGCAATGTAATATATATATATATATATATATATATATATATATATA
TGCTTGTCCCTGCTATATGTTGATTTTTTTTTTTAGAAAACAATGTTTTT
GACGAGTGAGATGCGATATATCTATTATTGATGAATATCATTATTGTCTT
GATTAGACTTGTGTTGTTTGAAATCCTAGAGAATGTGAATCTCAGACATG
AAAGATATATGTATATGCATAATGCGACTTATTGTTGATGTTGTTATTGA
TGAATTTAATTGATATGTGGTGATGTTGACATTTATGATGATATTGATTT
GAGATGACGTTGTTAATGATGATCATGTCAACATGAATTGATGTTATTAT
TGATGATTATGTTAATATGAAATGATGTGGTTGTTGTTGATAATGTCATT
GAGATGATGAGATGTTGATGTTGAGAGTGATATTGAAATGAGATGTTGAT
GATGTTGGAAATGCGTTGAGATGAAGCATGTTGTGTATGTTCGTGATGGG
GTGCATTGACCTTGTCGGATGTCCCTGGTAGGGGAAAATAAAGTGGTTAA
AGAGTTTAAGCATCTCTGAGGGGATGACTTAGGATCTTTAATTCATTCAT
GGTCAGTGTACTTGATGGTGCCCACATTTTATACGTTGTATGTTGTGTAT

FIGURE 26D

GTTCATGGGGGTGCATTGACTTTGTCGGATGTCCTTGGTGGGGAAAATA
GAGTGGTTAAAGAGTTGCATGTGTACGACAGGATGACCTCGACACTTATT
GTCTTGTTTTTCTAAGTGAGAGTGTCGTGTGGACACGCTTATGCTATTTC
CTTGGGGATGGTACCACATTGCATCTAAGAGTTGAGATCAGGTGCATGCA
TCATACTGAACATGATTAATTGGAACTATGTATGAATGATGACTATTTGT
TGAGTGTGTGTTGATTAATGAATGTTGTATAAGCTCATGATATTTGTTAA
TGTTTTCTTGCTAATTGTGGTTATTTGAATTTAGTATTAGTTCTTTTTAT
AATGAACTCACCCTTGCAATTTTGTATCGTGTGGTTGATACTTGTGATGA
TCGCGAACCTTGTTCGTGGGAGCAGAATGACAGCAGTAAGGTGCAGAAAG
TGAGATTCTGATGTGAAGTCGCCGAACTGACGTGATGACGTTGAGATTAT
TTTGAGAGAGAGTTGTGTTTTGTTAATCAACTCCTTCATAGTTGGTTCCA
TAATTTTTTTGTTGAATTAAGGATGTAAATCACAAACTTAATTATATGTA
TGAACAAATTTACCTTCCATTGTGTGAATGATGTGTACTAAGTTACTATG
CCTATATATATGTATGTATTCATTTAAGTAATGATGCGTTGTTTCGGAAT
GTATATCGTGAAATTAAAATTACTTTAATTTTTCATAAGCAAATTAATGG
AGTTTTTCATTTAAAAATTGAAATTTTTCGCAGTTTAGAGTGGTGATATC
GTAACGAAGAGGCGGGCCATTACAATGAGTGACCATACTATTAGAATGAA
AATAAGAAAATTAAAAAGTTGAGTTAGAAATTTTATTATATTTTATTTTC
AAAGTTAATATGTAATATATATTCTTGTGACCAACATGTTATTGCTTAGA
GTGAAACTAAATCTGTTGCAACCAAGTGACTAAGTGACTGAGTACAAGTG
GTTAGTGTATTTAAAATAAAGTTGAATCGTTTGAATATTACCTGAGTTCG
GCTTAACAGAAATAATTATTGGTAAGACTTTACTTAGCTTGTGACTTTAG
CATCATTTCCCATGATGAACTGAAAAGTTAAGACAAATCCCCTTGAGCCA
AGATTTTAGATTTAAGTCTTACATATTAAAAATAATTGAAAATAGTGACT
TCGTTAAAGATGAATAACTAAATTTCTCTATGAAGATGAGTTATCAGTAT
ATAAAATTAATAAATACTTTGTATTAATGTCATGGAAACAAATATAATTT
ATACTTAGTGCATGAGTTTAAATTATAGAAATATTCTTAAATATTAAATA
AAAATATAATAATAGTATATTAAAATTGTTAGAAAATACATTATAATTTA
TCTTTTACAGCAGATAAAAATAATTGTGAGGAGAAAAAATAAATTAGAGG
ATAAATATTTATAAAACTTTAACAAACTAATAAAAAAAGTTTTCATTTTT
AGAGTTATGTCTATTTATATTACATGTAAAGAAAATTTAAATTTTTATGA
GTAGTTGGATCTAGGACTTTAACTACACAATAATCATTGATACCAAGTTC
ACTTAAATTTATCTCAACAATTGATAAAAACTTATATTTCATAATAATTG
TTGATTTAAAATAAAAAAAAATATTTTATAGAAATTATATTTATTAAATA
TCATAAGAGAAAAATATATCTTTTTTTAAATATAATAAAATATTTTCATT
TGCTCATCATTTCTTTGTTGACTTAAATTTTCTTTCTCTCTCATTTTACT
ATTGTTGTTTGAGATAATCTCATTATTTTTTTTACTTAACTAACAGTAA
TATTTTTGTATAGATAAGATTTGAAGGATGAAATTTCATAAAAATATAAA
TCAAACAATTACAATAAATATGTAACATATAAAAGTAGAGTTGAATTAAA
TGATGATTTTTTATGCCACAATTTTAAAAGAATTACTTTTATTCCTCCCT
CTAGATACCGAAAACACCAATTTACTTAAGTAGAGTAAGGACAAGACCAG
ATATTTCTGAACTTTTTATCACATTCCCAACCTGAAAAAAACATGAAATA
AAAAACATTAATCACAGAAGCAGGAATCAAATGGATAGAATACTTTGTAA
GTCAAGACTAACGTGTTGAAGGGGCCATTTGCCCAGCTGACTGACTATAG
GATGTGTATCAGTCAAAACCTTCAAATACCGAGATGGGTTAAGGTAATGC
AATCTATAGCTTAAAAGGAATTTAGAAGTGAAAAATAATGTTTGCTTCAT
ATTATATCTCAGTCAATTTGGGAACAATCTTAAGGAGACACCGAGACAAA
TGTTGAGGAGCACGGTATGCCATAGCACCAAGTACTTGTACACTACTTTG
TTTTGTCCTCCAAGCTTTAACTTCAAGACCCCGAACAAATAGATTAGCTA
TGCGATAGTTCATCGAAATAGATGTTATGGATAGTAATTTTTTTAATTTG
TTCAATTTACATGCTATGTTGGAATGAAATTAATTGAAAAGAAGCATTGG
GCTGTAAACAAGGTTGCATTTCGGTTTGCAGTATATTTGTTTGTACTGAC
CCATGATGTTATGATTGCTCTTTCATCTTGCTTAGCAGTAAACGATACAT
AATATTGCATGACTTAAAAAGAAAGGCACAAATAAGGAGATTTGATGTTT
GCTTGCAGAATGCAGATTGATTTATGCTTGAAGGCTGACACCTTGCCATT
TTATCTCCTTTATTGTATTTTAACATGATGTTTTAATGTTTATTGAAGCT
CATCATATTGGACGTGCCACTGGTAGTGGGCTAGTGACAAGGTCTTTGGG
TAGTTTGCAGGTGATACTAGGTTCAAACATTTGTGCAATCATTTTTAAGT
AATTGCATTTCATTTGGACTAAAACTGGTATAGTTTATTGGATTGACTTT
TCAAAAACACCATGTCAATGTGTGCAACATAATTAAATTAATATAGATGT
AAATAAAATCTCAATAATTAGTCAATTACATCAATAAAATAAATAATGTC
TTAACAAAAGAAAATCCAAACAATAAATCTAAAATATGAAATTTAAACAT
CTCTAACAATAAATGATTCCATATTTGAAGTAGCTTGAACATTCTCCATC
TCCACATTTAAGAGTACAACAAAAATGAATCAGTCCCAACAAAAATAGGA
TAAAAACAAATTCTAGAGAGAGAAGAGATGTACTTTGCGTGGTGGCACGG
TGGTGGGCCGAAGCTGTGTCGCTGTGGTGTGTCGCGTGACTGCGTGAATA
TGAGTCGCGTTTTGTTTTCCTTGTAAGGGAAAGAGTGTTAAATATGATGT
GAACTATTTTTTATAATAAAAATATATTGAAATATCTTTAAAAATATTTA
TTTAACAATTATTTTTAGCTTAAATGATAAGAATTGATATTTTTATTATT
TATGACTTGCAAATATGAAAATGATAGATTAAAAGAAAAAAAGATCGAGA

FIGURE 26E

AAATATCAAAAAGGAAGATTTTTAGCATGTTATCACTTATATTTTTTTAT
CTTAATCTTTTATTTCTGTTATCTTTTATTTTTCTTATCTTATCTTTTTT
ATCTTTACCATCTTTTAATTTAAATCTTTTATTTTTACCTTTAAATCTTT
TATTTTTACCTTTAAATCTTTATCTTATATAATATATTTCTTCATTTGTT
ATTTTAAAAGAAAAGTTTAAAGTGAAAAAGAGAAAATCAAACCTAATATA
ATTGGGTCAGGGTCACACAAATCAAACCAAATGCGGGTTGCGGGCAACCC
GTGGACCCCGCGGCCAAACCCGCATAGTCCGCGGGTTAAGCGGGGCGGAC
CAAAAAATATGACATAACCATGAACTGTTTTAAAAAATTGGTTCGTAACT
CGAGCGGATCGCGGGCGCCACGGGCCAGTCCATGGACCTGGGCCCATTTA
CCCACCCCTAGTCTACAGGTTCCTGATCCTTTGCGATTAAGAGATGAACC
CTAGAGGCACATCAATGGCCTCTATGGAACTTCTCATCGAATGTGAAGCA
TAGCCCGTGCTTATGGCGCGAGGCTAACTCCTCCGGGGTGAGACGCCTGA
CGGTCGGAGCCTATGGCGGGGAAGGCAGCAAAGGGGGCAAAGGCGTGATA
CGAGGGGGAACCAAAGGGGCTGGTGGTGGAGCTACCAACGGTGGGGTCGC
GGCCGCGGTGGAGGCAGACGAAGGTCCGATAGCTTCTGCTCCTGGATCTT
CGCAAGGCTGGCGGCCTGGTCCACAGTCATAGGCTGGTGGACCTGGACTG
TGCGGCGGATCTCCGACGTCAAACCCGAGATGAAGCAAGGCAACAGGAAG
GGGGCCGACAAGCCGATAATTCTATTAGCCAAGTCTTCGAACTCCTTCAG
GTATGTTAGCACTGAACCCGTCTGAGTGAGTTTGAACAAGGCATCGACAG
GATCCTCATACGGTGATGAGGCATATCGGATTTGTGCAGGAACAGAGGTG
GAGTGGCAAGGGACTGGTGTGGGGTTGGGCGTGGTGGAGGAAGGCACAGG
AGCAAGGCGGTTGCGAAGCTTGTCCATATTGAGGGTCATAGAGTGCATGG
TATTGTCAAGACGAACAAGGGCCTTGTCGAGGTTGCGTGAGGCCATGAGG
ACAAACGAGAGCACCAATTGTTACGAACTGAACATAAATGCAGGAAATTA
AGAGCTGGCTTCGAGGCACCAGAACCTCCAGAGGAAGAAGAAGAGCAGAG
ATGAGAGTAATTTGCTAATTTCATTCATATCGTGCTGCTTATTACATGCT
ATTGTATTTATACTGATTTCTACATAACAGATTTTGTCCTTTTGTGCTAG
AGGAAATCAGAAATCGTTATTCTTGTCTCCCTTGCTTCTAGCACAGATCA
TTCAGCATCATTCCTTAGGATCACACGTAGTCCTTAAGGTAAGCAGGCTT
CGAGATCTTTCTTTTGGTATTAACTGCTGCTTGCACCTCCTTTTCTACTT
GATTTACACCCTTCTTTGCTATAGACACCCCTGTAGTTGCTATGTCTTGA
TTCACATCTATTTTTTCTGAATACATCCCTTTGTATGCTATGCTATCACT
CTTCCCTATCAGAGGGGGTCTCTGGTTTTGTTTTTCCTAATTACCATTAT
GTAAGATCTAGCTTGTATCCGCCTTCTTCTTCTTCTTCTTATTACAACTT
TTTCACAATATTCTTTACTATATTAGCATCTAGGCCAACCTGATAAGTCA
CGCACCACCATAATAATAATATTTAACTTTTTTTTATTTTTTAAAGAAAA
ATTAATTCCTTTATTTTTTTAAATATTATTTTTATATTAAAATATATTTA
GTAAAACAGTAATATTAAAAAAATTAATTTATTTTTAATGTAAAAATAATA
TTTAAAAAAATAAAGGAATTAATTTTTCTTTTTTTAAAAAATAAATTTTT
ATTTAACAAGTTAAATTAATAAATGAATTTTTTGTTTATAGTATTTTTTT
AAAAATGTATAAAAACTAATTATATATATATATTTTTAACAATTTATTTATA
CTGGAATACATTACATCATAAATAAAATACATGAACAATAATATTTATCT
AAGAAAAAACTGAAGATGAAGATATATTGAAATAATTTTTTCTGTTATGT
TTTTATTATCGAAAATTTTCACATTTTTTTTTCTAGAATGAATACCATAG
TTGTTAGGTAAAAAAACTATGGTAGGTTGTAACATGTCTCCTTCCCAAGG
ATTAATAATCAAATGAGGTTGATAATGGGAATGATTCATGTGTTAGTTGT
TTATGCTTTCATTATTTTCATGTTTCAATTATTATTGTTAGTCCATTCTG
TTATTTTTGCTTTATTATATGTTCCATTTATGATGTTTGTCTCTTTAATT
TTTAATATTTTATGTTATTTGAGTATTTTAATTTCTTAATATAATATAAT
TAAGATGTGATAATCATATATTTATTGGGTTTTTAATCAATCTATTTTTT
TAATCACTTTGTTTTTTAAATTTATTTTAAGATTATTAATTAATTATTTT
CAAACTATAAATAAATAATTAAACAAAAAATATTCTCATTATTTAAAAAA
CAAAATAATAATAATAAAAAATTTAGTTATTTTTTTATCTGAAAATAATA
TTTAAAAAACAAGTAAATTATTTTTAAAAAAATATAAAAAAAGAATTTAA
TAATTTTTTTTAAATTAAAAAATAATAGGAGCAAAGAGAAGTTGGGTTCC
CTAACCCCGACTTCTCTCTGCAAGCTAAAAAGGAGTGTTGTTTAGGAAAC
AATTTTGAGGCAGGTGTATTTTGGAAAAAATGAGGAGAGAGCAAGTGTAG
TGGAGTAAAAAAATCCTGTAAGGTTTTGTTTGGTAGTAAAAAGAAAAAAA
TAATTGTAATGAGAAAAAATAAGTTAGAGGATAAATATCTTCAACACTTA
AACAAACAAATAAAAAAGTTTTTCTAGGAAGTTCACTTAAATCTATTTTA
ACTATTGATAAAAATTTATACCTGTTGATTTAAAATAAAATTATATTTAT
TAAATATGATAGGAGAAAAAATATTTTTTACATATAGTAAAATATTTTCA
TTTGCTGAACTTAAATTTTCTTTATCTCTCATTTTACTATTGTTGTTTGA
GATGATCTCACTGAATATATTAATAATAAAATTTTTATATAAATAAGATT
CAAAGGATAATCACCAACCAAGAAATTTTATGGAAGTATTTATCAAATAA
TTACAATAGATATATAACATAAAAAAAAGAGTTGAATTGAATAATAATTT
TTCATGCCATCATTTCAAAAGAATTACTTTAATCACTCTCTTTATATTAT
TATTATTATTATTATAACATCTTCACAATATTTTTTATTTTATTAGTATT
TATTGATTTTATTTAATAAAAAATCACACACTTTTCTTTTTGCACACATC
TTTAATCTACATATAAGGATATTCAAATCTTGACTTCATTAATATATATT

FIGURE 26F

ATTGTTTTTAGGGATCAATTAGCATGTGTCTTTTCTTTAATTCTTTCTCT
TTTAATTTGTTCAACATTTTTATTGTGTTAATAATTTTTTAATCTCATTT
TTTTATTTTCCTCCTAACAAAATTTATTCTATATATAAGAATTAATAAAG
ATTTAAATCTTTTACCACTTGATTAAAAAACATAAATTACTATCAATTAT
TTTAACTTTTTATAAAATCATGATTCAGATCTTTATACAATAACATATCT
CATCATGTGTTAGTTGTTTATATCATCACTCTTTAAATCTCTTGAGTCTT
TAGTTTAGAGGAGCTAAATTCAAAATAGAAATATCAAGAAAGTAACATAT
GTGAGGATCAAAAGTAAAGAGACTCCCAACGTGATAAGTCACCCACCACC
ATAATAATACAAATAATAAAAATAAAAAAGACCATACTTTTGTCTTGCAC
AGCAGAACGAGTGAAGGTGAAGAGAGTTGACTTAAGCCAAATCTCATCAC
ATCAGTTCATAGCAACCAATTCCCTTGCCTTTGTCTTTCTACTCTGATCA
TCTTTTGTTCTTGAGATAATGGCTGCAGCACTGGTCGGTGGTGCCTTTCT
CTCTGCTTTCCTTGATGTGCTTTTCGACAGGCTGGCTTCACCTGACTTTG
TTGACTTGATCCTTGGAAAGAAGCTTAGCAAGAAGTTGCTTCGAAAGTTG
GAGACCACTCTCAGAGTGGTTGGAGCTGTGCTTGATGATGCCGAGAAGAA
ACAGATCACAAACACCAATGTCAAACACTGGCTCAATGCTCTCAAAGATG
CTGTCTATGAAGCCGATGACTTACTCGACCATGTTTTCACCAAAGCTGCC
ACCCAAAACAAGGTAAGAAACTTGTTTTCTCGCTTTTCCGATCGGAAGAT
CGTTAGTAAGTTGGAGGACATAGTTGTCACCCTAGAGTCTCATTTAAAAC
TCAAGGAGAGTCTTGATTTGAAAGAGAGTGCAGTGGAGAACTTGTCATGG
AAAGCTCCATCAACATCTCTGGAAGATGGATCTCATATATATGGTAGGGA
GAAAGATAGGGAGGCCATAATCAAGTTGTTGTCGGAGGATAACAGTGACG
GTAGTGAAGTGTCTGTGGTTCCTATTGTGGGCATGGGTGGGGTTGGAAAA
ACTACTTTGGCCCAATTGGTGTACAATGATGAGAATTTGAAAGAGAAATT
TGATTTTGATTTTAAGGCATGGGTTTGTGTTTCTCAAGAATTTGATGTTC
TGAAGGTCACAAAAACTATAATACAGGCGGTTACTGGAAATCCTTGTAAA
TTGAATGATCTGAATCTACTTCATCTTGAATTGATGGACAAGCTGAAAGA
TAAAAAATTCCTAATTGTTTTGGATGATGTTTGGACAGAGGATTATGTTG
ATTGGAGTCTTCTTAAGAAACCATTTCAATGTGGGATTATTAGGAGAAGT
AAAATTCTTCTAACAACCCGCAGTGAAAAGACAGCCTCCGTAGTCCAAAC
GGTTCAAACCTATCATCTAAACCAATTGTCGAATGAAGATTGTTGGTCAG
TGTTTGCGAACCATGCGTGTCTTTCCTTGGAATCGAACGAGAACACAACA
CTAGAAAAAATTGGAAAGGAGATTGTTAAAAAGTGCGATGGACTGCCTTT
AGCAGCACAGTCCCTTGGAGGCATGTTGAGAAGAAAGCATGACATTGGGG
ATTGGTATAATATTCTGAATAGTGACATTTGGGAACTTTCTGAAAGTGAG
TGTAAAGTTATTCCAGCACTGAGACTTAGTTATCATTATCTCCCTCCACA
TTTAAAACGGTGCTTTGTTTATTGTTCGTTGTATCCCCAAGATTACGAAT
TTGATAAAAATGAATTAATCTTGTTGTGGATGGCTGAAGATCTTTTGAAG
AAACCAAGGAAAGGTAGGACTTTAGAAGAGGTTGGTCATGAGTATTTTGA
TGATTTGGTTTCGAGATCATTTTTCCAACGTTCAAGTACAAATAGAAGTA
GTTGGCCTTATGGTGAATGTTTTGTGATGCATGACCTCATGCATGATCTA
GCCAAATCACTCGGTGGAGATTTTTATTTTAGATCAGAAGAACTTGGGAA
AGAAACAAAGATCAATACTAAGACTCGTCATTTGTCATTTACCAAATTCA
ATTCTTCAGTCTTGGACAACTTTGATGTTGTTGGTAGAGCAAAATTTCTG
AGAACTTTCTTGTCCATTATCAATTTTGAAGCTGCTCCATTCAACAACGA
GGAGGCACAATGTATCATTGTGTCGAAGCTT
ATGTACTTGAGAGTTTTATCATTTTGTGACTTCCAAAGTTTGGATTCTTT
GCCTGATTCAATAGGTAAATTGATCCATCTGCGCTATTTAGATCTTTCTC
ATTCAAGTGTAGAAACACTGCCAAAGTCATTGTGTAATTTATACAATCTG
CAAACTTTGAAGTTGTGTAGTTGCAGAAAGCTGACTAAGTTGCCTAGTGA
CATGTGCAATCTTGTTAACTTGCGTCATCTTGAGATACGTGAAACTCCTA
TAGAAGAGATGCCGAGAGGAATGAGTAAATTAAATCATCTACAACATCTG
GATTTCTTTGTTGTGGGCAAGCACAAAGAGAATGGGATCAAAGAATTGGG
AGGACTTTCAAATCTTCGTGGTCGACTTAAAATTAGGAACTTGGAGAATG
TTTCCCAAAGTGATGAAGCGTCGGAGGCAAGGATGATGGATAAAAAACAC
ATTAATAGTTTATGGTTGGAATGGTCTAGATGTAATAACAACAGTACCAA
CTTCCAACTAGAAATAGATGTGCTTTGCAAGTTACAGCCTCACTTTAACA
TTGAATCGTTGAGAATAAAAGGCTATAAAGGAACCAGATTTCCAGATTGG
ATGGGAAATTCTTCCTACTGCAATATGATGAGTCTAAAATTGCGTGATTG
TGACAACTGTAGTATGCTTCCTTCACTTGGACAACTACCTTCTCTCAAGG
TCCTTAAGATTGCACGATTGAATAGGCTGAAGACTATTGATGCAGGTTTT
TACAAGAACGAAGATTGTCGTTCTGGGACGCCCTTTCCCTCCCTTGAATC
TCTGGCCATTCATCAAATGCCTTGTTGGGAGGTGTGGAGTTCCTTCGATT
CAGAAGCTTTTCCTGTGCTTGAAATTCTTGAAATACGTGACTGCCCCAAA
CTAGAGGGAAGTTTGCCGAATCACCTTCCTGCTCTGAAAACACTTACAAT
TAGAAATTGTGAGCTGCTTGGCTCTTCTCTCCCAACGGCTCCCGCCATTC
AAAGTTTGGAGATACGTAAAAGCAATAAAGTAGCACTGCATGCGTTTCCT
CTCTTGGTAGAAACTATAAAAGTAGAAGGAAGCCCAATGGTGGAGTCCAT
GATGGAGGCCATCACAAACATCCAACCAACTTGTCTCCGGTCTTTAACAT
TAAGGGATTGCTCGTCAGCCGTGTCATTTCCgggtggtcgtttacctgaa

FIGURE 26G tcactgaagagtctgtatatctcggatcttaaaaaactggaattcccgac
gcaacacaaacatgagttactggaaacactgtcaatagaaagcagttgtg
attcactcacatctcttccattggttacctttccaaatctcagagatctt
gaaatcagaaactgtgaaaatatggaatctcttttggtatcattctggag
agaaggattgcctgcgcccaacttgattactttccaagtgtggggctctg
acaagttgaagtcgttgcctgatgagatgagtactcttctcccaaagtta
gaacgtctcctcatatccaactgcccagaaattgagtcgtttccaaaacg
gggtatgccacctaacctgagaatagtttggattttcaattgtgagaaac
tactgagcagcctagcatggccatccatgggcatgcttactcatctctat
gttgggggtcgatgtgatggcatcaagtccttccctaaggagggtttgct
gcctccctcccttacgtatctgtatctaagtggattctcaaatctggaga
tgttggactgcacggggcttctccatctcacatccctgcaacaattaacc
atagacggatgtcctttgctggaaaatatggtgggagaaaggcttcctga
ctctctaataaaattaaccataaagagttgtcctttgctgaaaaaacgat
gccggaagaagcaccctcaaatttggcctaaaatttcccacatccctggc
attaaggttgacaatagatggatttag
ccaccaaggaggaccaacaggtatcttctaagtctaaccaactagaaaac
tagttctgtcaaggatatgtttcatttcatgtctttctccttttacgttt
tactaaatccaattcattctgaaatggaaattgaccttgtatatatgtta
ctgaatctacagagaatcaacaaatcatcaaaggcaacgtggaaattgac
cttgtatatatgtttcgaagaagtaacgatacaggtactaagtaacaaca
ttgataaatacttaaatataatgattctccggaaaaatgttacacatcag
tattgttatattctaacttaatttctccttaagattattgaggccagagt
gaaaatgaccgtgggaaacttattttgtttttcagatatggttgattgg
cccggagaaactgtacctacccatgaatctaagttcaaatttgaactagt
gctaaatgtaacttttaatttaattgacgtcaaattgacactttctcaat
agctaaatttttatttgtgaggtttttgttaggtacaatgtgaaggatg
aaaaggtgtaccaagtgaactttagaaggattggatgatttcagcttatc
tcttatctcctgtcctataaattaatagtggtatgattattctaaaaata
tgatagatatgtagatacgtaagaattgataaaagcataataaatataca
attgcaattcggtaaattgaagaacatacatacttcttagacattgctaa
aaacaaaatcaaaaaattgtagatcatttttttcctattgttcacaaataa
gaatggtactatcaatgatcaatctcatttctttcttgaaattatctata
aacaaaacaattttcatatttggttcatcaagaaacaatactttttatat
ttctatattatatttacttctatgttacatgtcactatatttgattatca
taatttttttttaaaagaattggtcactttacatatatgtaccagtgaaa
tatatcaatatattggtatcggatatagatgcatgaagcaaattaaagta
tcagtactttgtagcaaaacacattcttcaaatcatgacatgaggtaaaa
aaatatgatgatatttttgtaagtattggaaaaaaaaaaaaaagtaaagc
ttctgaaatcaaagagacactaattttccacaacatccttcaattgggcc
caagcttcctttcctattgacaaataactggttgttagtgccagcttttt
ctttttctagttttccattgatggttaaaagctaatatgaacctgtcac
tccttaaaatttccaccaaagtttggtaaataaatatataggagagtgaa
taatgcaagccttgcattctatctctaagttactaggtatatgaaacagg
tatgggtatggttttagaaggtatgtggttcatcactatttatattttta
ctacaagaaccaggtaaactttattatggtacagtaaatttagtgtgagg
ttgtaactacgttatatccatctaacttagcacgataattaaatttaaaa
gcaaaaagataagaaaaaggccaatctaacaattgttacctctcttgcat
gaaaaaatcagaaacaaaagccccactctttcctccatggtgcctgtaat
taacaagcacttcaaaaatcaatgttaattaattaatttccataagaaaa
aaaagacagaagctaatgaaatttaaggggtacaacaaagatttgtagaa
cgatcattaatattagtgcaacacatcatgatgaagtgcatgacataata
ataatgtgaaaccaatcatgataagaacagaaaataaatcagtgcaatta
catgattagaaaataaagaggcgatatatcatattcctattgatcagaca
atatgacaacgtgttaaacaaatgtgtcaggtgcaataatgaggggatag
agaagagaaggatgataaagaatgtggttatgacttctacaaagtcgaat
tatttactttttaatttttatattttcctttcacttttctaatagtt
gtccgattaagaggagtttatagagtagattaaattggttttgaaaaaga
gaaatatcatcttatacaatttttggttttcttaattcattgttcaattg
atgtagtttaaaatttaaatatgatttaataagtttggattgatctcgat
cttaagttttaattttaattctatttttcaaaaaaaaaatattaaagat
atataataactgtgatacaaagtaatttaaaatattttaccaaaaaatgt
aatttaaaatatcacatatatataaatcattttaaagctaatagtaatat
tttctaaaaagaagctaaaagtatatctctgttatacaagttgataatta
tatttatatatacttgaatagttactgaatattatatttaattaaattta
cttttcataaataatttttaagtaatgtaataatttttatatatatatat
atatatatatatatatatataataaataaaaatataaacatcaatgat
atcataaaattttggtaataataatttttaaaaaaaaattgtgaattaac
taacctttcaggttctagagtaatttattaatccaaattgccttgaagca
tattcccatgcaagtcaagttgagggacttgatggaggccatttctgaaa

FIGURE 26H tagagttaggagaagttattttcagccaacgagagattctgcaagctccc
taatttaccaattcccaatggcaaggatgaggaaaagagtttataagaga
tatccaagaattcaaggcttttgaaatcagcaatgttgtcaggtagtgtt
cctcatatggcaaggatgaggagactttatttcatgtaaaaatattttc
ctaggagtatatatatgatatatgattatgttgggtcatatttatggtat
ctcaaggtttcaattgacagttttggctatctcggaaattttccttgtac
caaaatattaacaattgaaacatgtttcaaatccagttacttttggtacc
atagaattgaaattaatttatttcaaatacattgtattcttaatatatta
aatatgttaatttgttatttttttaaaaaataatcattagaaacaagtt
ccggtataggaggcatacttagtgtttaggctaaggaataatgccaccgg
gttcaggaacaagcctgttgaggtgtcccttaacgttccgtgacatcccc
actcttgcatggacattctgtgcagagaaacgatgggtggatggaggtaa
gattgggtgagttctataatagtcactgatgagaaccccaagagcagcat
tgaagttcgaggaatccaaataagaccagcgtaaattatcaatttcatct
cttaaatagtcactaaaataaaatataaattaattctttcaagtattgaa
acattcttcaaattaatccttatacattgataaaatatttcaatgtatat
atgcattaatggatatttaacactttagaaattacttatatatgattttg
ttattttaaggactatttataagaaagagtaatactctagatatcaaatt
ggtagttaatttaattactcttgaaataagcatgctcaatttataatatg
ttgttttgttggcaattaaataagcacaccctctctagaatggtgtgtat
gtacttttctgtatatgttgttttgtttgtatacttttgcttgcatagat
cccaaaacaattgggtgattttcattcttctataaattttcttataaata
tttaagaaatttttgctaacacaagactggtgatatgatgttaagattga
cataacaaggacgtgagagttcaatttttcacatgccatgtcacccatca
tagtaccttgttggcatgtattaagtcaacaacaaacttccattttaacc
atatctttgatcaccgcaaaaaattattaaatttactattaaattgttta
tatttatttttctttattgttgggctgagatttttttagttactaaaatt
ataaaagtttttttaatctctgaattttgataaattgttctttttagttt
ctgatttaataaattaatattttataataattttaaaatgaaaaattcaa
tggctaaaaaataaaaatcaattaatggttgctaaaacctaaaggatgtt
gctaatcagtgccctaaggcattagttaataaattaaaataaaaaaatat
ttattatgaaaatcataagagtatgtaaaaaaaatcataaataatactat
tttatatatttcaataaaaaaattattatttagttctttataaccaatt
aataccttaaaaacactagttaacatttaccataattaaattaactaatt
ttgaaataaacttcaattattcaattatgtcttaataagcttgatttttc
ccttactactgcaagtttgcatcctttattaaagtgaagtgatgaaatgt
tgtctgccatttacgaatatcactgaaattaaagttgttttctagttgaa
tttataataagttttttttaattgataaatttaatcgttattttgtgagt
ttttgttagtataaggaagtaaagtcacaaatttcttttctttcataat
tttttaaccatcccatcaatattatatctccatttacaataagttaataa
ctagcaagatacccatacatttacgcagatcgctctcctttttttacgcat
attcaaaatacacttgcttaaaaaagataattagctatttagtatttata
ttcaataaacatgaaaaaaggattagaatattcaagcaaaaaaaaaaatca
aaatcctaatttttaggctatttaaatcattgtcttctattatttgaaaa
ttgaaactattattcatatttttacctgttttatcttcataaattctatt
ttaatatatttattatgtatttatgtaaaaaaatcaacactattaaaatt
aatttaatttgtgatattattcagtatttaatattttgttataaaaatat
atttaataaattaatattaaaatatttcttatataattatgaaaaaatga
tatttaaacttattttataaatattagttaataaaatttccatatatgaa
gttattaaaaaaagagacaaaataatattttgtaataaacatattaccta
attagatttaaattaattaatagtataaaaatttcaactacataacataa
attattcaaaaaatatttcattcataaaattattttatacggtttctaag
taaaattgattttataggatttcaaatttttaaaaagatatcgtggattc
tttaatatgttgttatgttaaatattcttaaagaaaaagctttgtcaccc
ataataattggcctgtaatgacgttaaacacgtgattgtttttcatgaat
gatatttttggtctctatcataaaaaatatatattaattaaatgtattat
tgagtaagtattttaaaagtattgtattaaaaattatatttaataattaa
attttagtagttattatatattatgtagaagtgattataaagtaaaaatg
ggttttcaaattaaaaaaaaaatattattttttactctttgatatacaatt
gtgttaactactaggcgaaagaactgtgtcatttgtaataattttgagta
ggattatttctcatcaatgattattaagatccctgtcatgattaaaatga
ttttaatttatgatattattaagtttttgatatgaatttgtgtgaaatac
ttgaagaaagagcatattcagtaagtaacctaaaactattttgtaataaa
aatacattttataaattgattttaatatttttattactacatattatgta
aaaattaaaattaatataatttatgattttattgagtaagtaatttaaaa
ttatattgtgataaaaatatatttaataaaatgttatataattatgtaag
aatgatttccaaataaaaataatattataagatttgaaagtaaaaaaaaa
aatactatttcagttttttttatgtgtagttgtgttaactacttggataa
aaaaaatattgtggtctataatagtctttggcaagattttcttgtcacta
atcatatttgtaatctctagcataactaaaattattataatatatgatat

FIGURE 26I tattaagtcttttggtatgtagttttataaaatattggaagaaatagttt
tgttgcatataataatccaatttcgagtaggatcctttcttatgaatgat
atttatgatttctactacaaaaatatttaaactaattaagtttatgagat
tattgacgaaatgatttaaaattagttttaataaaaatatatttaattaa
ttaatttttttacatagagtcaaaacattatttgtaataaatttgttaac
taattaaaattaaattatttatagtataaaaatttcaaccttataatata
aatattaatgaataaaatatttatttataagattatttaattttatttta
tatgatttctaattaaaactaattttataaaatttcgaattaaaaataaa
ttgttgagtctttaatatgcaattgttttaattactcgcgaaagagtttt
tttttcctataatggttggcccataagaagaattatttttagtcattat
cccaaagagaataaaactaatttaatttatgctatttcttagtaaataat
ttaattttttttaaaataaaaatactaagtgactaatcttcctcaagaat
tctgagtgcacataatttgactattcccctcccaacccaatttatttcat
acacaaggatcaacgggggactaatatattaatttaatatatctattat
atatttacttaaaatgattttatagaatttaaaaataaaaataattatta
ttgaatttttggtttgcatttgtgttaactactcagggtaggaacattga
cgtccataatgacattgagtaagattgtatcccatcaatgatatttgtga
tctctatcatatttaaaattatttaaatttatgatattgttaaatcttta
atatgtacttttatgtgtgtttcgttgcatttgcacataagatctctagt
aggattattttacttgaatcatccaaggttgttaaactcatgttttaaat
cgtagaattgtatgattttacgattccactaagcttcagcgagttaaatc
gaaagcagaattgaaaacggaatagactcatctgatttagcgcaaacttg
ggcgagtttgggtagactcgcgagtctgctacgagtatgtggatttacga
aaacccgaaacggtgtcgtgttgtagctacttatttgagtagactttgtc
taccttgttcgagttatgcaaagtgcaaaattgtttggttcatgcttctt
ggcttcttgctgtgatgcagtcggtgctagagtgctacggtggggtgcga
cggtgaaaggaggttttcggtgttggagtgcgactgtgcaagtgtgtgac
acagtgcttctggatcttttgttggaaggaggttttcagtgaaaggaggt
tttcgatatatgggatcaaggtgatttgttgcgaacaaaagctaaacttc
aaattgcacagggccagttaaggaacaaaagctatactgatatacgcagt
tgctagttgttcttcaaattcagagtaaaggttttaatttggttctggga
agaagctatacaaggtttgttgttgtaataacttatgctgattgaatatt
tctgaaccatgggcctttattcctgttatttactgttagaattggatgaa
tgcagtctcatgaaccttttgaatttattagatttttcaagaaatttgtg
atcatgggtttgttagaaaaaaggaagtgtcctgatagtttgtaccttag
aaagtgagaatattgatatataggaaagtaatagtgagagtattgaagat
ttgatcaccattttatttggtttgaaatggaggcatttcgtgaaaaagta
gagtgcagaatgcatagagttcctcagaatttcgcatgtgttgatgaagc
tttttgaagcatggtacacctttaagggcatactactgttgggttcatat
atttttggtttaatgagagaattgaagatttgatcaccattttatttgg
tttgaaatggaggcatttcgtgaaaaagtagagtgcagaatgcatagagt
tcctcagaatttctaacatactactgttgggtacaccttgaagcatattc
ccatgcaagtcaagttgagggacttgatggaggccatctctgaaatagag
tcaggagaagttattttcagccaacgagagattctgcaagctccctaatt
taccaattcccaatggcaaggatgaggaaaagagtttataagagatatcc
aagaattcaaggcttttgaaatcagcaatgttgtcagg
tagtgttcctcatatggaattgttggacaaggagggtttcactactgaca
aactgctaactcagttggagaatgttgtgtaagtgttaatgcaaaggaca
ataccgaaatgcatgaaaagatcatcatctcataacagactctttcacat
acgaccgaccacctcaactgcaatggcatattttggtgaacgaaattgtt
ctgactcacgtagattcaaagtgaatattcataaatcaggcattttcttt
gctttgtgacaatgtcactaaaccttcaattagttgatcttgttctagct
ctatagggtaataaaagtatatcaatgtctgcaaaatacatcaataagat
caagacaccaaaatatatatatgtgcttgaattatttataaacttttatt
ttgattccgggttacaacttatcttaaaatatttcttttttctctgttt
cttctttcaagtttttaatttaacttcctgggtaatctagattccataaa
atacttctggaaatgcagatatgatcttgtttttttttttttgtattttac
tattctatatattttatattagtgttgtttattttcttaaaattatcata
cataattatatatgctatatacttgttgatagggaagaagatagaagctg
gttttcaaggaccagggcctccacggagagaagaatgagaagaataaggg
aagggaacaattgtatattccattgattgatgttgttattacatagtatt
atttatactgatttctcaataatcgaatttgtctttttgtgctacagaat
atcaggaaattgttaagtttgtctattcctacccgaccagcatcattctt
ccagatatgatgcacctgcttgtttcacacctaatccttgaggtaagtgg
gtcttgtaattgctctcttggtcttgttttctaattgcacccccttgctt
ctgttgcttgcttgctgcaagttcccactgattcaaattccaacagttct
gcaaataaaattgaagaagaagctagaggtgggaaatactcaagtcattc
tcttgaaaaagttgctgcaatgatatgcaacaaaatatcactatacggag
tcaaggtaattattgtgtttcacatgaacatttcttccatgaaaatatat
atttttttactttgtaatctctttatagtatgcatggaaaattaatttc

FIGURE 26J tgatttttttctctgtagtgttatatattatttttaatcacattttctta
tttattagtttgtttcttatttgacatcatgtaaatttggagatttgggt
tagaaatgtttttggaattttcctggttagaacttgataggtccataatg
aaggtatataaaaggatagggaaaagagggggtggggaatagaaaaagaa
aggacaaatgggcctcagaaacaagacatgcttgtgtatgacagcagaaa
gaatcagccgtacaagttgcactagctgaagtggaaaaggaacataggtt
ggcataatggaatggatagcatttgatctttaataaatttttgctttgta
ataggttcctaatatttaaaaagttttgtttgaaatacttatcattagtc
aaaatctgttatttgctcacacgatcgttaaccagccacacagacatgtc
atgtgtgatttttgtctgactgagattaggattaatgataagaaactata
gtcaaaatcccttgggcataaaagaatcattcttcagcaaataacggatt
ttgactaatgataagaaactatagtcaaaatcccttgggcatcaaaaaat
cattcttcagcattcctctacgttttcacacaacccattatagtttcttc
tatacctttcttatggatttgtcactatgacttcgtcactcgtgaagatc
caaggtgaagaggtcctcaccaacgatttttaggatcttgcaatcaattt
tacattttcaaatcaaaccaagccaactcccaactcaagaaattcacatg
gataaggtttctaagagaacacatcaaaatagtttcatgggtagaagaag
gtcaacaaaaccttaccctaaaatgcgattccgctcggtccattgcatag
agcacgaaaaaatgagtgggatagcgatgtctgaacttgtcgtcgacctt
tcatagttgcgagctctttttgcaaacccttgctttcatggttgtctctt
cttgttctcccttcttaaaggtcaccaccaacccagccatcggccaccac
tggtgttgccagtcgtgccactgctcgtgccagcgccagctaccaccagt
aacttccttcaactctcaaacctcacttctctcccagtctctctctcaca
cttggccctcaaactcacttgtgtgtcgtaggtgaagagaaggaaatgat
gaaaacaaagaggagggtttctttggggaagggggggtccatgagtgatt
ttttagagaaggagatttgttgttgccatggggagccatggttcaagaga
agaaaaaaagaaaatgggttagaattattgttgtgttgctgccatggggt
ttcaagggaggtttgggggggttttggagacacaatagcggtggtgtggag
ctag
tggaggagttggttggggactggtgggggtggtttggaggattcggggac
ttaatgatgtcgtttttttactttttttctataaaaaaataaaaaatctta
cgtgatcggttatcgatcacatatgaagataatggatttcgactaacggc
aggaacttcgaacaaagctttttaaatattagggacctatcacaaagcaa
aaatttattagggaccaaatgcaaaaaatgagtatttatcagagaccaaa
aatatatttaaaccattacctaattgcaactcactatgtgataagtttgt
tgacttttaaaataattattttaaagtaattcaaacaataatttataata
gtgtaaaatcattttacatcatcaatacataagtattaaactcgatatct
ctctctatatattttctgttcgagattgattgaaattatcttatttgctt
aacatattaaaatgcgtcatttttaatgatattattggtctatagttttt
atgtaatacatttaataatgtttagaaatatttgtatataaataactttt
atctatttttttcaccagagcctatgaaatgtaagcacaggtttgttaatg
agtagcacaacatggacagtttgtcaaaggcccaatagcatctttaatgg
gattcttgaactcaagaaccctatccactagatctactattattcttatt
aagagtttttttaagatggagattgggttctaggaaaagaactactatttt
ttcaaaaatattattttttcttgtgctagtaaaatctaataatccaaatt
ggattctactattagaataacaaatgatagaagttcttgcatcctatata
acatcatgggactcacaaaaaataatccaagaacctaaaatggattcttt
gacaaaaatgttctaagaatctcaatatttcccacttaagaaatataac
tatcaaatcaatataatatgaaacgagttcaatctttattgattcacttg
acgcaagctatatgcacaactgacataatagattttaattctaaataaca
tgcaataaaaatataacaaacctgttccggaaaaagcctcctcaaaatga
agcacattcagtcccccccacaatttttacaagttggggtctttatgctgc
atcaaaatattccatcatatcccgcaaatgtttcgtgctattaagtttat
gttagttgtcccttcatgatgcatcaccagcatatcataaacaatcagtt
aatcccttattctgccgaaatagtcggattatcgtcaatccccccttaagg
tggtcgtttgatcccgcttggcaaggcccaactttgaaagtgaattgacc
taagcctcttttatgggcttgatgcgtgatagaagatcggaacataatcc
aatacattccaatctgaaccaaaagataaccccttagcttcaagcacaca
gtgcgtaaaagctaaagatgtagaagatcggaacatgatccgatctagac
cagaacaaaacctaaaaccaaactactaactgatctataatttttttatac
atcataaaactaaaaaaacaaagcaaactaagcacataatcttacaatcc
ctactgaatttactaaaagagacacagatagttgaggtgggaaatgttgc
caaaccagaaatgaattatcacgggaaagtatggctgatgtggttacaat
taggagtcttaattcatcttaaagcattaatatttttttaacttaacaaat
ataattaaagagaagtaacgaataagataa
tgatctaaaattcttgtattgattgaaaatagcgtaaaaagatgtttcaa
agataatgatacaaactctttaaatgcaaatggttacatgcacaaagcac
gtatatatatatatatatatatatatatatatatatatatatatatatat
atgaatatatctacgtacattcatatatgtatgtatatgcaaacatatat
acatggatgcatatatatatatatgcactaacaaacatatatacatctgg

FIGURE 26K atagagagaggatcagaatagcaggacaaagacaaacttgtatttgttgc
ttccatactagaattgcattttcttcagggttagatgcatcaactgtgtg
ggagggaaatttattaacagcgctaagtattctcctaaccttaagcagga
tctccttctggtctcttgccatctgagcttgcatgtcaatgatgaaaaac
ctgacaagcgagtccgcaagtgcctcaagttgttcctggtaacaagcttt
gtcgcattgaccgaaaaaaccaaggtgacgttgaccaaaaaatagtcctg
acaagatgttggtaaaaaaatataatcggttgatatcgatcacaaacat
cattgactaaggttaacaaaaaaatttctaaccgacattgatcaaaaaat
aacttcgaccaaggtcgatcaaaagaaacgtaaccgatttcggccaacag
aaatattttatatgatagcctttagttgcaaaaagtgtgaaccagggggt
attttgacagccgtaaaacatatctcatggcagtggttgttatataaggc
aaaaaaccatgaactttcttctcttgctggtgtttggagccacttcaaat
gtgattgatgttagagaagttaacagtggcatttttttaggactgaaagtt
aacttaggagaaaccatttttttatgtatgtaatacggtaacacatgtac
ctcttgcagagattggggagaaattgcaacttttctttttacattttgcc
ttaaaaaaagtgttcatatttataaaaataattttctatttaacttggat
atttttctcatactactacactaaggtatatacaacctaaggcgtgttt
cttaatttggagagtgatgcttgattgattgactaccaacgaaggataat
ctaaaaaggagaaacaccatttataatcctcatgagtgcttatgtccctt
ttgccttgaggtagatgagtcggtatctcactgtttcttctcatgtcata
aaattcttggtactaatttggaggcaatgttactcttggctgctggctgc
atgtaaatgtggtgttgccacaatgaccagaatcacatttttggcaagat
tctgtattcgtaagttcaaagaaggaggcagatgtatggagggcggtgtg
ggcatcagaaattttggtgtgtatggaatgctaggaatgagtgtatgcta
aggaattaatggctctttcaatgctgagaaaattacgcagaatatattat
tctttgcacgatcgtggattaataaaagccagagtccctaattttaatta
ttgttttacttaatgatatatggcacctggagcttgtttcatgaagagac
aattttgaatgaaatgtgaagttaatttgattcggtggtagctgctcttc
gagtgggatcatcccaaatgcaaccgatgtttatgtgcacgatggtgggg
gctggttagtgatgccgcatcaatgttgcatggctttagacatgatttta
aattgcaattatgattgcgttgcatgcaacgaacctaaaaatcttacatt
gtggataattatggaaaaatacaaactgatgtgatcataattataattgt
gatgtgattacagagtcaaaatacattagcgttatgactgcaattatggt
tgctgactacattttaaaaccatgactttgggtgtaatggtccatgttcg
aagctagctatctttctttctactgtcactggtgtatatgtttttggatc
ttaggtaattttggtaccatttaatacaaatcattttgttggaaaaaaaa
tacggtagcctacatgcaatatacaaaataaaattgaattactatatatt
atcataaatagtagagtataagaagtaaagaaaattctaaagataaacat
gcatttaaaaacatatgaaagaatttttaactatatatataacatcttt
aattagcttaatagaaatgcgaaagtacaataaaaaagcaaaaacataat
aggcgtgacaaatcggttgcttatatacaataaagacaataaagtttgaa
actaaaaccttatccagactatccaaatatccctaattaatcatgaaaaa
attagaacagaagacatttaataactatagcaacagtaacagcagcagct
atagctaatggcgcgatcaccgaatcggaaaacttttcatcattgaagta
ttctatttcactaaccctaagcaagatctcaagttgatcgcgtgcaataa
gagctggcatttcaatattgaaaaacctctcaattgagtctgcaagatct
ttaattttagttttccacggtaagaattcttagccacaaaattgtatttc
cctatttttgaacacttgtaaacaacctctttgctcttcctcaatagttg
tatcagtggctcaagttcctgctgtgaacgacccaacatattcctgtact
tacctatctcctgccatgtttacgctacatattttctagaatgttatttg
aatttcattaaaaatcataagaagcaagtttgaatttttcagtgaaattt
ttacttaggtttagttagacaaaccctatttaaagctatattgttttgct
tatcggaaccaaaccaattagttcggtttgaatttcttagttaaatcaag
tctggcttaaaccaaatcgagctaaccctaggttaattgtttcaaaggtc
gggttgaagctctttaaacttgagaatgtgttctacaaaccgaagtacct
tattatttaaagaatatctaatatttttttgtttttacattattgttgaa
tccattttatatgatttttttttttacaaaatattaaactttatttactaa
ataagatttatataaaattcatgaaggtaaaagtaatattttttatctttt
aatgtaaggcttggtttcactttcgtccttcaacttttttttatttgatt
tatttcagtgatcatttaatatttatggattcttccttaaggaatcttga
tatttttctatagttttaattgttcttcggttatttattcggaaattgag
aggggatcatcacctccaaagatttcctcgctcccattaacaaaaatgtc
taaacaattaccttccttctaaaatttttgtgaagtacctccactaatta
aactcaacatattctcccaaacttcattttctttgaaaacaatgttgtct
aattcaagacgctttgatataaaatatttagtcgctagaacgagaaaaaa
aattgaataaaaagaagggatttttttcttcttaatgtacttcatgctac
ttatttgttggcaatcattattaatatatattatcttatatgagacaatt
ttcaacatttaaatgttaattttgtaagtatcttggtagtatcctttttt
gataaggaatagatattattttgagattatattatgatgatgaattgtct
cataaaaacacgaggcaagcacttgaaaggaacaaattctctaatttctt

FIGURE 26L agtgggtagtgggagagaggaagtaaacttgcttcaatatgcaaatgacg
cttgacgcactctttacaggagaagcaaccatttctaaggtgcttaccat
aaaaagcattttgagaggctttgaacttgtctcgggcctcaaaatgaatt
tccatcaaggcttttgtggtgccttgggagtggatattgataccttgatg
aattatgcaagcttgttgatttacttgagacaaactatatgcacaactga
caaaatggactttaattctaaatagcaataaaaagatatataataaacct
gtttcagaaaaggcttcctcaaaatggaggctacttcaatctagtacggt
agttgacttactaagtacgaaacaacaaattattaagttgataattaatt
aaacatgattttaaatacttacatatttattcacatgtaactataaagat
ttagtaagagcataaataaaaaatgttgttataatatataattttaaatt
taatataataaaaatgtgtttgcaaaatagaaatataaatataaagcgtg
acaacacatgtttttcgttaataataataataataataataataataata
ataataataataataataataataataattacaaatgggttttgaca
aaatcatacctggcgaaaatatgcagtttagtgacggaattaatttgtga
ttcatgcaatacaatttgtaccaatcatcatcatcatcataatctctttt
tcgttttatttatcaacgttgctacttagtacgaaaattatttgcacaaa
atacaaacagaatgatgctatctgttatgaaaggtaaatccacacgaatt
acacgaaatatagaatggacggttatgattttataaaatgaatatcgatt
aaaaaaatttaaaaggcatgtaaaaagagatttacagacatcaaacttcg
tgcgactttttacaaaatcctctttcctaacacagcattatattttccata
cacaaaccgtaaactatagattctaaagggtatacctggacttattaaca
actttttaagagctaatattcattaaaaataccaaataggttttgacata
atcacacgtcgtgcagatttgacaaaaaaagaattcttacaatttatttt
tccctcaaattggtgggtaaaattaaatataatgtgacttagtgcaatta
tgtgaaaaacaagttgcaggcacttggtatttatgaggtgaagccaaagg
attcgtgcaatttatttacgaaaattatatattggcatgaaacacacgaa
ctgtaaactatatatagtcactaacttgtatacgtacgaactgtaacaat
aaattttaaaataaaatattaattacaaatataaaatgggttttgacaaa
atcgatcacacctcgggcagatttgacaaaagataattcgccacgaattc
tttttcgtcaattatttaacacaaccttcctttttacgaattgcacaaatc
cacttttaaaatacaagaaaatttgttttaaaaattcagccagccgaca
tagaggtgtatgcaggtaagtttggattgagtttcatcatacctatgact
taagaatgagttgatttgagtcatttgtatacgattttaattaaattatt
gggttaaaatatttaaatttgtatgctatttattaaatccaatatttata
taagctaaaattcttattaattagaatactgaaaacattacttataaatt
aaatattgtcagatgctgcgactaagtgaggtggtggaaagatgtcaaga
gttgaactctaatttttgaaagaataacaatgacactcggtacttattca
actctcttgttatgcacgaaacatatatttaataataaattcacgcgcgt
atttataaaattatatgagaatttttttgtataaaaatttaaacacataaa
ttatattaaattaaaatgttatggtaattttaaaatatgaatgataaaat
gattcaattattatactttaatttttaaataaaaattgatttttataata
tttaaagtttataaataatattttgaataattttacatataaattaatta
aattaaatgcaaaaaactgagattaaatatttcttaaaactaattaatta
atatatgaatcactttatattagtaattgcgagctgcttgtctcttctct
cccaacggctcccgccattcaaagtttggagataattaaaagcaataaag
tagcactgcattcgttacctctcttggtagagactatagaagtagaagga
agctcaagggttttttatttaaaaaatatataaaaaatgaatttaataat
ttttttaaattaaaaaataataggagcaaagagaagttgggttccctaac
cccgacttctctctgcaagctaaaaaggagtgttgtttaggaaacaattt
tgaggcaggtgtattttgaaaaaaattgaggagagagcaagtgtagtgga
gtaaaaaaatcctataagattttgtttgatactaaaaagaaaaaaataat
tgtgatgagaaaaaataagttagaggataaatatcttcaacacttaaaca
aacaaataaaaaagtttttctagaaagttcacttaaatctattttcacta
ttgataaaaatttatacctgttgatttaaaataaaattatattttataaa
aattatatttattaaatatgataggagaaaaatatttttttacatatagta
aaatattttcatttgctggacttaaatttttctttatctctcattttagta
ttgttgtttgagatgatctcactaaatatatttttacttgactaataataa
aaattttatatagataagattcaaaggataatcaccaaccaaaaattttt
atggaagtatttatcaaataattacaatagatatataacataaaaaaaga
gttgaattgaataataatttttcatgccaaattactttaatcactctata
ttattattattattatcattattataacatcttcacaatattctttattt
tattagtatctattatttattttattaattttatttaataaaaaatcaca
aacttttctttttgcacacatctttaacgtacatataaagatattcaaat
cttgaattcattaatattatgtttttagggatcaattagcatgtgtcctt
tctttaattctttctcttttaatttgttcaacattttttttgtcttaata
atttttaatctcatttttttattttcctcctaacaaaatttattctata
tataagaattaataaaaatttaaatcttttaccacttgattaaaaaacat
aaatcattatcaattattttaaatttataaaatcatgattcagtattaga
tctttataaaataccatatctctatgacaattttaatgattaggttgaaa
tataaactaacacgaatttaagtaaatatttcactatttactttcacatt

FIGURE 26M gaaaaattgattttaaattttaactttagaaaaaaaattctaagttgagg
atctttacataacttttggatttaacaaaaaaattcattttcaattttac
tattaacttattttttaaataaaaatatccaaaacacatgtgcaaactgc
ttcaatacaacttgtctcacagcatcaaagcacaggaacataattatgca
cagtacccttgcagccatccacacatatcaccaagaaaaaaacacacacc
actgctccacacggtttggaaagcgagaaagctggccatcactaacttta
attatagcattttagaaatataatccatttttttaaaattaacggtagaa
atatcatcactctttaaatctcttgagtctttagtttagaggagctaaat
ttaaaatagaaatatcaagaaagcaacatgtggggatcaaaagtaaagag
actcccaacgtgataagtcacccaccaccaattcccttgccttttgtctt
gcacagcagaacgagtgaaggtgaagagagttgacttaagccaaatctca
tcacatcagttcatagcaaccaattcccttgcctttgtctttctactctg
atcatcttttgttcttgagataatggcagcagcactggtcggtggtgcct
tcctctctgctttcttgatgtggttttcgacaggctggcttcacctgag
tttgttgacttgatccgtggaaagaagcttagcaagaagttgcttcaaaa
gttggagaccactctcagagtggttggagctgtgcttgatgatgccgaga
agaaacagatcacaaacaccaatgtcaaacactggctcaatgatctcaaa
catgctgtctatgaagccgatgacttactcgaccatgttttcaccaaagc
tgccacccaaaacaaggtaagagacttgttttctcgcttttccgatagga
agatcgttagtaagttggaggacatagttgtcacacttgagtctcattta
aaactcaaggagagtcttgatttgaaagagagtgcagtggagaacttgtc
atggaaagctccatcaacatctctggaagatggatctcatatatatggta
gggagaaagataaggaggccataatcaagttgttgtcggaggataacagt
gacggtagagaagtgtctgtggttcctattgtgggcatgggtggggttgg
aaaaactactttggcccaattggtgtacaacgatgagaatttgaaacaga
tatttgattttgattttaaggcatgggtttgtgtttctcaagaatttgat
gttctcaaggtcacaaaaactataatagaggcggtgactggaaaggcttg
taaattgaatgatctgaatctacttcatcttgaattgatggacaagctga
aagataaaaaattcttaattgttttggatgatgtttggacagaggattat
gttgattggcgtcttcttaagaaaccatttaaccgtgggattattaggag
aagtaaaattcttctaacaacccgcagtgaaaaaacagcatctgtagtcc
aaactgttcacacctatcatctaaaccaattgtcgaatgaagattgttgg
tcagtgtttgcgaaccatgcatgtctttccacggaatctaacgagaacac
agcaacactagaaaaaattggaaaggagattgttaaaaagtgcaacggac
tgcctttagcagcagagtcgcttggaggcatgttgagaagaaagcatgac
attggtgattggaataatattctcaatagtgacatttgggaactttctga
aagtgagtgtaaagttattccagcactgagacttagttatcattatctcc
ctccacatttaaaacgatgctttgtttattgttcgttgtatccacaagat
tacgaatttgaaaaaaatgaattaatcttgttgtggatggctgaagatct
tttgaagaaaccaaggaaaggtaggactttagaagaggttggtcatgagt
attttgatgatttggtttcgagatcgtttttccaacgttcaagaacaagt
agttggcctcatcgcaaatgttttgtgatgcatgacctcatgcatgatct
agccacatcactcggtggagatttttattttagatcagaagaacttggga
aagaaacaaagatcaataccaagactcgtcatttgtcatttgccaaattc
aattcttcagtcttggacaactttgatgttattggtagagcaaaatttct
gagaaccttcttgtccattatcaattttgaagctgctccattcaacaatg
aggaggcacaatgtatcataatgtcgaagcttatgtacttgagagtttta
tcattttgtgacttccaaagtctggattctttgcctgattcaataggtaa
attgatccatctgcgctatttagatctctctttttcaagaatagaaacac
tgccaaagtcattgtgtaatttgtacaatctgcaaactttgaagttgtgt
agttgcagaaagctgactaagttgcccagtgacatgcgcaatcttgttaa
cttgcgtcatcttggtattgcttatactcctataaaagagatgccgagag
gaatgggtaaattaaatcatttacaacatctggatttctttgttgtgggc
aagcacgaagagaatggaatcaaagaattgggaggactttcaaatcttcg
tggtcagcttgaaattaggaagttggagaatgtttcccaaagtgatgaag
cgttggaggcaaggatgatggataaaaaacacattaatagtttacagttg
gaatggtctggatgtaacaacaacagtaccaacttccaacttgaaataga
tgtgctttgcaagttacagcctcactttaacattgaatcgttggaaataa
aaggttatgaaggaaccagatttccagattggatgggaaattcttcctac
tgcaatatgattagtctaaaattgcgtgattgtcacaactgtagtatgct
tccttcacttggacaactaccttctctcaaggaccttggaattgcacgat
tgaataggctgaagactattgatgcaggtttctacaagaatgaagaatgt
cgttctgggacgtcctttccctcccttgaatctctgtccattgatgacat
gccttgttgggaggtgtggagttccttcgattcagaagcttttcctgtgc
ttaacagtcttgaaatacgtgactgccccaaactagagggaagtttgccg
aatcaccttcctgctctgacaaaacttgtgattagaaattgcgagctgct
tgtctcttctctcccaacggctcccgccattcaaagtttggagatatgta
aaagcaataaagtagcactgcatgcgtttcctctcttggtagaaactata
gaagtagaaggaagcccaatggtggagtccgtgatcgaggccatcactaa
catccaaccaacttgtctccggtctttaacattaagggattgttcgtcag

FIGURE 26N ccgtgtcatttccgggtggtcgtttacctgaatcactgaagagtctgagt
atcaaggatcttaaaaaactggaattcccgacgcaacacaaacatgagtt
actggaaacactgtcaatagaaagcagttgtgattcactcacatctcttc
cattggttacctttccaaatctcagatatctcagcatcgaaaagtgtgaa
aatatggaatatcttttggtttcaggggcagagtcatttaagagtctgtg
ttatttgttaatttacaaatgccccaactttgtatcattctggagagaag
gattgcctgcgcccaacttgattactttcagtgtttggggctctgacaag
ttgaagtcgttgcctgatgagatgagtactcttctcccaaagttagaaga
tctcaccatatccaactgcccagaaattgagtcctttccaaaacggggta
tgccacctaacctgagaagagttgagattgtcaattgtgagaaactactg
agcggcctagcatggccatccatgggcatgcttactcatctcaatgttgg
gggtccatgtgatggcatcaagtccttccctaaagagggtttgctgcctc
cctcccttacgtctctgtctctatatgacttgtcaaatctggagatgttg
gactgcac
GGGGCTTCTcCATCTcACATCCCTGCaACAATTACAAATTTTTGGATGT
CCAAAGCTGGAGAATATGGCTGGAGAAAGTCTTCCTTTCTCTCTAATAAA
ATTAACCATGGTGGAATGTCCTTTGCTGGAAAAACGATGCCGCATGAAGC
ACCCTCAAATTTGGCCTAAAGTTTCCCACATCCCTGGCATTAAGGTTGGC
AATAGATGGATTTAGCCACCAAGGAGGACCAACAGGTATCTTCTAAGTCT
AACCAACTAGAAAACTATTTCTGTCAAGGATATGTTTCATTTCATGTCTT
TCTACTTTTACGTTTTACTAAATCCAATTCATTCTGAAATGGAAATTGAC
CTTGTATATATGTTACTGAATCTACAGAGAATCAACAAATCATCAAAGGC
AACGTGGAAATTGACCTTGTATATATGTTTCGAAGAAGTAACGATACAGG
TACTAAGTAACAACATTGACAAATACTTAAATATAATGATTCTCCGGAAA
AATGTTACACATCAGTGTTGTTATATTCTAACTTAATTTCTCCTTAAGAT
TATTGAGGCCAGAGTGAAAATGACCGTGGGAAACTTATTTTTGTTTTTCA
GATATGGTTGATTGGCCCGGAGAAACTGTACCTACCCATGAATCTAAGTT
CAAATTTGAACTAGTGCTAAATGTAACTTTTAATTTAATTGATGTCAAAT
TGACACTTTCTCAATAGCTGAATTTTTATTTGTGAGGTTTTTCGTTGGGT
ACAATGTGAAGGATGAAAAGGTGTACCAAGTGAACTTTAGAAGGATTGGA
TGATTTCAGCTTATCTCTTATTCCCTGTCCTATAAATTAATAATGGTATG
ATTATTCTAAAAATATGATAGATATGTAGATAAGTAAGAATTGATAAAAG
CATAATAAATATACAATTGCAATTCGGTAAACTGAAGAACATACATACTT
CTTAGACATTGCTAAAAACAAAATCAAAAAATTGTAGATCATTTTTTTCC
TATTGTTCACAAATAAGAATGGTACTATCAATGATCAATCTCATTTCTTT
CTTGAAATTATCTATAAACAAAACAATTTTCATATTGGTTCATCAAGAAA
CAATACTTTTTATATTTCTATATTATACTTACTTCTATGTTACATGTCAC
TATATTTGATTATCATAATTTTTTTTTAAAGAATTGGTCACTTCACATAT
ATGTATCAGATATATTGGTATCAGATATAGATGCATGAAGCAAATTAAAG
TATCAGTACTTTGTAGCAAAACACATTCTTCAAATCATGACATGAGGTAA
AAAAAAATAAGATGATATTTTTGTAAGTATTGGAAAAAAAAAGAGTAAAG
CTTCTGAAATCAAAGAGACACTAATTTTCCACAACATCCTTCAATTGGGC
CCAAGCTTCCTTTCCTATGGACAAATAACTGGTTGTTAGTGCCAGCCTTT
TCTTTTTACCAGTTTTCCATTGATGGTTAAAAGCTATTATGAACCTGTCA
CTCCTTAAAATTTCCACCAAAGTTTGGTAAATAAATATATAGGAGAGTGA
ATAATACAAGTCTTGCATTCTATCTCTAAGTTATTAGGTATATGAAACAG
GTATGGGTATTTGGTTTTAGAAGGTATGTGGTTCATCACTATTTATATTA
TTACTACAAGAACCAGGTAAACTTTATTATGGTACAGTAAGTTTGGTGTG
AGTTGTAACTACGTTATATCCATCTCACTTAGCACGATAATTAAATTTAA
AAGCAAAAAGATAAGAAAAAGGCCAATCTAACAATTGTTACCTCTCTTGC
ATGACAAAATCAGAAACAAAAGTCCCACTCTTTCCTCCATGGTGCCTGTA
ATTAACAAGCACTTCAAAAACCAATGTTAATTAATTAATTTCCATAAAAA
AAAAAAGGCAAAAGCCAATGAAATTTAAGGGGTACAACAAAGATTTGTAG
AACGATCATTAATATTAGTGCAACGCACCATGATGAAGTGCATGACATAA
TAATAATGTGGAACCAATCATGATAAGAACAGAAAATAAATCAATGCAAT
TGCATGATCAGAAAATAACGAGGCGATATATCATGTTCCTATTGATCAGA
CAATAGGACAACGTGTTAAAGAAATGTGTCAAGTGCAACAATGAGGGAAC
GGAGAAGAGAAGGATGATAAAGAATGTGGTTATGACTTCTACAAAGTCCA
ATTATTTACTTTTTTAATTTTTTATATTTTCCTTTTCACTTTCCTAATAG
TTGTCGGATTAAAAGGAGTTTATGGAGTAGATTAGATTGGTTTTGAAAAA
GAGAAATATCATCTGATACAATTTTTAGTTTTCTTAATTTATTGTTCAAT
TGATGTAGTTTAAAAAGTTGCACTAACTGAAGTGGAAAAGGAACATAGGT
TGGCATAATGGAATGGATAGCATTTGATCTTTAATAAATTTTTGCTTTGT
GATAGGTTCCTAATATTTAAAAAGTTTTGTTTGAAATACTTATCATTAGT
CAAAATCCGTTATTTGCTCACACGATCGTTAACCAGCCACACAGACATGT
CATGTGTGATTTTTGTCTGACTGAGATTAGGACTAATGATAAGAAACTAT
AGTCAAAATCCTTTGGACATCAAAGAATCATTCTTCAGCAAATAACGGAT
TTTGACTAATGATAAGAAACTATAGTCAAAATCCCTTGGGCATCAAAAAA
TCACTCTTCAGCATTCCTCTACGTTTTCACACAACCCACTATAGTTTCTT
CTATACCTTTCTTATGGATTTGTCACTATGACTTCGTCACTCGTAAAGAT

FIGURE 26O

CCAAGGTGAAGAGGTCCTCACCAACGATTTTTAGGACCTTGCAATCAATT
TTGCATTTTCAAATCAAACCAAGCCAATTCCCAACTCAAGAAATTCACAT
GGATAAGGTTTCTAAGAGAACACATCAAAATAGTTTCATGGGTAGAAGAA
GGTCAACAAAACCTTACCCTAAAATGTGATTCCGCTCGGTCCATTGAATA
GAGCACGAAAAAATGAGTGGGATAGCGATGTCTGAACTTGTCGTCGACCT
TTCATAGTTGCGAGCTCTTTTTGCAAACCCCTTGCTTTCATGGTTGTCTCT
TCTTGTTCTCCCTTCTTAAAGGTCACCACCAACCCAGCCATCAGCCACCA
CTGGTGCTGCCAGTCGTGCCACTGCTCGTGCCAGCGCCAGCTACCACCAG
TAACTTCCTTCAACTCTCAAACCTCACTTCTCTCCCAGTCTCTCTCTCAC
ACTTGGCCCTCCAACCCACTTGTGTGTCGTAGGTGAAGAGAAGGAAATGA
TGAAAACAAAGAGGAGGGTTTTCTTTGGGGAAGGGGGGTCCATGAGTGAT
TTTTGAGAGAAGGAGATTTGTTGTTGCCATGGGGAGCCATGGTTCAAGAG
AAGAAAAAAAGAAAATGGGTTAGAATTATTGTTGTGTTGCTGCCATGGGG
TTTCAAGGGAGGTTTGGGGGGTTTTGGAGACATAATAGCGGTGGTGTGGA
GCTAGTGGAGGAGTTGGTTGAGGACTGGTGGGGTGGTTTGGAGGATTCG
GGGACTTAATGATGTCGTTTTTTTACTTTTTTCTATAAAAAAATAAAAAA
TCTTACGTGATCGGTTAACGATCACATATGAAGATAATGGATTTCGACTA
ACGGTAGGAACTTCGGACAAAGCTTTTTAAATATTAGGGACCCATCATAA
AGCAAAAATTTATTAGGGACCAAATGTAAAAAATGAGTATTTATCAGAGA
CCAAAAATATATTTAAACCATTACCTAATTGCAACTCACTATGTGATAAG
TTTGTTGACTTTTAAAATAATTATTTTAAAGTAATTCAAACAATAATTTA
TAATAGTGTAAAATCATTTTACATCATCAATACATAAGTATTAAACTCGA
TATCTCTCTCTATATATATTTTCTGTTCGAGATTGATTGAAATTATCTTA
TTTGCTTAACATATTAAAATGCGTCATTTTTAATGATATTATTGGTCTAT
AGTTTTTATGTAATACATTTAATAATGTTTAGAAATATTTGTATATAAAT
AACTTTTATCTATTATTTCACCAGAGCCTATGAAATGTAAGCACAGGTTT
GTTAATGAGTAGCACAACATGGACAGTTTGTCAAAGGCCCAATAGCATCT
TTAATGGGATTCTTGAACTCAAGAACTCTATCCACTAGATCTACTATTAT
TCTTATTAAGAGTTTTTTAAGATGGAGATTGGGTTCTAGGAAAAGAACTC
CTATTTTTTCAAAATATTATTTTTTCTTGTGCTAGTAAAATCTAATAAT
CCGAATTGGATTCTACTATTAGAATAAAAAATGATAGAAGTTCGTGCATC
CTATATAACATCATGGGACTCACAAAAAATAATCCAAGAACCTAAAATGG
ATTCTTTGACCAAAAATGTTCTAAGAATCTCAATATTTTCCCACTTAAGA
AATATAACTATCAAATCAATATAATATGAAATGAGTTCAATCTTTATTGA
TTCACTTGACGCAAGCTATATGCACAACTGACATAATAGATTTTAATTCT
AAATAACATGCAATAAAAATATAACAAACCTGTTCCGGAAAAAGCCTCCT
CAAAAAGAAGCACATTCGGTCCCCCCACAATTTTTACAAGTCGGGGTCTT
TATGCTGCATCAAAATATTCCATCATATCCCGCAAATGTTTCGTGCTATT
AAGTTTATGTTAGTTGTCCCTTCATGATGCATCACCAGCATATCATAAAC
AATCAGTTAATCCCTTATTCTGCCGAAATAGTCGGATTATCGTCAATCCC
CCTTAAGGTGGTCGTTTGATCCCGCTTGGCAAGGCCCAACTTTGAAAGTG
AATTGACCTAAGCCTCTTTTATGGGCTTGATGCGTGATAGAAGATCGGGA
ACATAATCCAATACATTCCAATCTGAACCAAAACAAAACCTAAAACCAAA
CTACTAACTGATCTATAATTTTTTATACATCATAAAACTAAAAAAACAAA
GCAAACTAAGCACATAATCTTACAATCCCTTCTGAATTTACTAAAAGAGA
CACAGATAGTTGAGGTGGGAAATGTTGCCAAACCAGAAATGAATTATCAC
GCTCCAAATTAACTTTGGAAGCCAACCTGCACATACGTGTCTTCATGAAG
AGTATGCTGAAGCTGGATCCTCCAATCTTGCTCCAGCAGTGAGCTGATTA
AGTTGATGAGGGTAGCATACGTGAGGATGAAACTTGTTGGTTAATTACTT
AATTTCTTCCTAGGACGAGTCTAAGAATCAGACTCAAACTAATAGAAGCC
TAGATTCAAGGCATGACAGAGACCATAAAAGATGGCATGGAGTTCAGCCT
TGAGATTGGTAGACACTCCACACGATCTTGATTTCATATTTTTTTTCTTA
AAATAACTACATACATATTAAGTAGCATGGTTTTAAATTATGATTGTGAT
TACTTTAAGGTGAGTCATAAAATCTTTTTATATATTGCAGCTAATCACTG
gaaagtatggctgatgtggttacaattaggagtcttcttaaagcattaat
atttttaacttaacaaatataattaaagagaagtaactaataagataat
gatctaaaattcttgtattgattggaaatagcgtaaaaagatgtttcaaa
tataatgatacaaactctttaaatgcaaatggttacatgcacaaagcacg
tgtatatatatgtattcatacatacatacatatatatatatatatata
tatatatatatatatatatatatatatatatatatatatatatatata
tatatatataTATA
TATATATATATATATGTATATATATACATATATATATATATATATATATA
TATATATATATATATATATATATATATATATATATATATATATATATATA
TTTGAATATATCTACGTACATTCATATATGTATGTATATGCAAACATATA
TACATCTGGATAGAGAGAGGATCAGAATAGCAGGACAAAGACAAACTTGT
ATTTGTTGCTTCCATACTAGAATTGCATTTTCTTATATCAACTGTGGAA
GGGAAATTTATTAACAGCGCTAAGTATTCTCCTAACCTTAAGCAGGATCT
CCTTCTGGTCTCTTGCCATCTGAGCTTGCATGTCAATGATGAAAAACCTG
ACAAGCGAGTCCGCAAGTGCCTCAAGTTGTTCCTGGTAACCAAGCTTTGT
CACATTGACCAAAAAAACCAAGGTGACATTGACCAAAAAAATAGTCCTGAC

FIGURE 26P

AAGATGTTGGTAAAAAAATATAATCGGTTAATATCGATCACAAACATCAT
TGACTAAGGTTGACAAAAAAAATTTTAACCGACATTGATAAAAAAATAAC
TTCGACCAATGTCGATCAAAAGAAACATAACCGATTTCGGCCAACAGAAA
TATTTTATATGATAGCCTTTAGTTGCAAAAAGTGTGAACCAGGGGGTATT
TTGACAGCCGTAAAACATATCTCATGGCAGTGGTTGTTATATAAGGCAAA
AAACCATGAACTTTCTTCTCTTGCTGGTGTTTGGAGCCACTTCAAATGTG
ATTGATGTTAGAGAAGTTAACAGTGGCATTTTTTAGGACTGAAAGTTAAC
TTAGGAGAAACCATTTTTTATGTATGTAATACGGTAACACATGTACCTCT
TGCACAGATTGGGGAGAAATTGCAACTTTTTTTTACATTTTGCCTTAAA
AAAAGTGTTCATATTTATAAAAATAATTTTCTATTTAACTTGGATATTTT
TTCTTATACTACTACACTAAGGTATATACAACCTAATTAAGGCGTGTTTC
TTAATTTGGAGACTGGTGCTTGATTGATTGACTACCAACGAAGGATAATC
TAAAAAGGAGAAACACCATTTATAATCCTCATGAGTGCTTATGTCCCTTT
TGCCTTGAGGTAGATGAGTCGGCATCTCACTGTTTCTTCTCATGTCATAA
AATTCTTGGTACTAATTTGGAGGCAATGTTACTCTTGGCTGCTGGCTGCA
TGTAAATGTGGTGTTGCCACAATGACCAGAATCACATTTTTGGCAAGATT
CTGTATTCGTAAGTTCAAATTAAGAAGGAGGCAGATGTATGGAGGGCGGT
GTGGGCATCAGAAATTTTGGGGTGTATGGAATGCTAGGAATGAGTGTATG
CTAAGGAATTAATGGCTCTTTCAATGCTGAGAAAATTACGCAGAATATAT
TATTCTTTGCACGATCGTGGATTAATAAAAGCCAGAGTCCCTAATTTTAA
TTATTGTTTTACTTAATGATATATGGCACCTGGAGCTTGTTTCATGAAGA
GACAATTTTGAATGAAATGTGAAGTTAATTTGATTCGGTGGTAGCTGCTC
TTCGAGTGGGATCATCCCAAATGCAACCGATGTTTATGTGCACGATGGTG
GGGGCTGGTTAGTGATGCGCATCAATGTTGCATGGCTTTAGACATGATTT
TAAATTGCAATTATGATTGCGTTGCTTGCAACGAACCTAAAAATCTTACA
TTGTGGATAATTATGGAAAAATACAAACTGATGTGATCATAATTATAATT
GTGATGTGATTACAGAGTCAAAATACATTAGCGTTATGACTGCAATTATG
GTTGCTGACTACAATTTAAAACCATGACTTTGGGTGTAATGGTCCATGTT
CGATGCTAGCTATCTTTGTCGAGATAGAAATATAATCTAACCATGGAATT
TGCTTTCTTTCTACTGTCACTGGTGTATATGTTTTTGGATCTTAGGTACT
TTTGGTACCATTTAATACAAATCATTTTGTTGGAAAAAAAACTACGGTAG
CCTACATGCAATATACAAAATAAAATTGAATTACTATATATTATCATAAA
TAGTAGAGTATAAGAAGTAAAGAAAATTCTAAAGATAAACATGAATTTAA
AAACATATGAAACTAATATATATATATATATATATATATATATATAATAA
TAATAATAATAAGAGATTGTTTTAACTATATATATATAACATATTTAATTAG
CTTAATAGAAATGCGAAAGTACAATAAAAAAGCAAAAACATAATAGGCGT
GACAAATCGGTTGCTAATATACAATAAAGACAACAAAGTTTGAAACTAAA
ACCTTATCCAGACTATCCAAATAACCCTAATTAATCATGCAAAAATTAGA
ACAGAAGAAATTTAATAACTATAGCAACAGTAACAGCAGCAGCTATAGCT
AATGCCGCGATCACCGAATCGGAAAACTTTTCATCATTGAAGTATTCTAT
TTCACTAACCCTAAGCAAGATCTCAAGTTGATCGCGTGCAATAAGAGCTA
GCATTTCAATATTGAAAAACCTCTCAATTGAGTCTGCAAGATCTTTAATT
TTAGTTATCCACGGTAAGAATTATTAGCCACAAAATTGTATTTCCCTATT
TTTGAACACTTGTAAACAACCTCTTTGCTCTTCCTCAATAGTTGTATCAG
TGGCTCAAGTTCCTGCTGTGAACGGCCCAACATATTCCTGTACTTACCTA
TCTCCTGCCATGTTTACCGCTACATATTTTCTAGAATGTTATTTGAATTT
CATTAAAAATCATAAGAAGCAAGTTTGAATTTTTCAGTGAAATTTTTACT
TAGGTTTAGTTAGAAAACCCTATTTAAAAGCTATATTGTTTTGCTTATCG
AAACAAAACCAATTAGTTCGGTTTGAATTTCTTAGTTAATAAATCAATTT
TATATGATTTTTTATACAAAATATTAAACTCAATTTACTAAATAAGATTT
ATATCAAATTCATGAAGGTAAAAGTAATATTTTTATCTTTTAATGTAAGG
CTTGGTTTCACTTTTGTCCTTTAACTTTTTTTTATTTGATTTATTTCAGT
TATCATTTAATATTTATGGGTTCTTCCTTAAGGAATCTTGATTTTCCTAT
AGTTTTAATTGTTCTTCGGTTATTTATTCCGAAATTGAGAGGGGATCATC
ACCTCCAAAGATTTCCTCGCTCCCATTAACAAAAATGTCTAAACAATTAC
CTTCCTTCTAAAAAATTTGTAAAGTACCTCCACTAATTAAACTCAACATA
TTCTCCCATACTTCATTTTCTTTGAAAACAATGTTGTCTAATTCAAGACG
CTTCGATATAAAATATTTAGTCGCTAGAACGAGAGAAAAAAAATTGAATA
AAAAGAAGGGATTTTTTTTTTTCTTCTTAACGTACTTCATGCTACTTATTT
GCTGGCAATCATTATTAATATATATTATCTTATATGAGACAATTTTGAAC
ATTTAAATGTTAATTTTGTAAGTATCTTGGTAGTATCCTTTTCTGATAAG
GAATAGATATTATTTTGAGATTATATTATGATGATGAATTGTCTCATAAA
AACACGAGGCAAGCACTTGAAAGGAACAAATTCTCTAATTTCTTAGTGGG
TAGTGGGAGAGAGGAAGTAAACTTGCTTCAATAGGCAAATGACGCATGAC
GCACTCTTTATAGGAGAAGCACACTTTTCTAAGGTGCTTACCATAAAAAG
CATTTTGAGAGGCTTTGAACTTGTCTCGGGCCTCAAAATGAATTTCCATC
AAAGCTTTTGTGGTGCCTTGGGAGTGGATATTGATACCTTGATGAATTAT
GCAAGCTTGCTTATTTACTTGAGACAGACTATATATGCACAACTGACAAA
ATAGACTTTAATTCTAAATAGCAATAAAAAGATATATAATAAACCTGTTT
GAAAACGGAGGCTACTTCAATCTAGTACGGTAGTTGACTTACTAAGTACG

FIGURE 26Q

AAACAACAAATTAATGAGACTGCTGACTACTGATTTCATAGAAAGATTTA
GGAAGATGAGGAGTAAGAAATGTATGGTAAAGCTTCTAGGAGTAGAATAT
GTTACTATGTCTTAAAGTAAAAAAATATTTATGTTTAAAAGATGAATTAT
GATTCATAATTATTTTAATTAAATATAAATAATAAAAGTTATATATAATA
TATTATTGGATCATAATTTATAATTTTATGTTTGTATTTTCAGTCAATAC
ATTTATAAAACAATTTAGCATAACATTTATGAACTAAATTTAAAACCTTT
ATTTAATATTTTAAGATTCTTTCATTAGAAACAAGTTCCGGTATAGGAGT
TGGTATCCTTTCAAATGATATAAAGCAATAGATTTAAATTTTATATTCTA
TTTTATTGTGTCAAAATAATGTATTAAATTCTTTGGTAAGAGACACTATA
ATTTTAAGTTATTAAGTTGATAATTAATTAAACATGATTTTAAATACTTA
CATATTTATTCACTTATAACTATAAAGATTTAGTAAGAGCATAAATAAAA
AATGTTGTTATAATATATAATTTTAAATTTAATATAATAAAAATGTGTTA
GCAAAATAGAAATATAAACATAAAGCGTGACAACACATGTTTTTAGTTAA
TAATAATAATAATATTAATTACAAATATTAAATAGGTTTTGACAAAATCA
TACCTGGCGCAAATATGCAGTTTAGTGACGGAATTAATTTGTGATTCATG
CAATACAATTTGTACCAATCATCATCATCATCATAATCTCTTTTTCGTTT
TATTTATCAATGTTGCTACTTAGTACGAAAATTATTTGCACAAAATACAA
ACAGAATGATGCTATCTGTTATGAAAAGTAAATCCACACAGAATTACACG
AAACATAGAATGGACGGTTATGATTTTATAAAATGAATATCGATTAAATT
TAAATGTTATGGTAATTTTAAAATATGAATGATAAAATGATTCAATTATT
ATACTTTAGTTTGTAAATAAAAATTGATTTTTATAATATTTAAAGTTTAT
AAATAATATTTTGAATAATTTTAAAAATAAATTAATTAAATTAAATGCAA
AAAACTGAAATTAAATATTGCTTAAAACTAATTAATTATTATTATATCAT
CTGCTCCATTATAATTGTTGTGTAAAAAATAATAATTCTAAAATAATTTT
TATTTTTATTTTTTAATGTAAAATTAATTATGTTTTTTTACTTATATTTC
TTATATATGAATGATGAACTACAAAATTTAAAAATAAATTATTGATGATA
TAAAGTTAATTTTATAAAATTATTTTTTATTTTTTTATTTATATAAAATA
ATGTATGATGATAATTATTTTCAGAAGAAAAGCAACACTTTTCTAAGATA
AATTGTTATAGATGTTTAATATTATATTTTGCTTGTAAGACAAAAACATA
CTAACTACTAAATTATCTAATTTATGTATATTTTTAGTCCTTTGCATAAT
CGGGCGATAACTTATCATATGAAAGAATACTGATGATGATAAATACTTTT
TGAAGAATAATAATTTTTATGAAATATTTGAATTAGTTTTACATTAAGAG
TTTCTAATGATCTTAAAATGATTAAATGTATTATATTATATTTAGTAATA
TACTTAAAAATTTAAATATTGTTGTAATTTTAAAATATGAAAGGATAAAA
TAATTGAATTATTTTACAATGGTATTTCAAACAAAAATAAATAGTTATAC
TTTTTTTTTATAATACTAGTATATGTATAAAATAGAAGAAGATAGATAAA
TAATACAAGTTATATCCAATTACTACAAGTACGCACCGATCAATTTCAAT
AAAAAAAAAAAACAAGGTGTGAGTGAAGTCAACAATTAAGATAGAAATGA
AGTTGGAAGAATCATCGATTTTAAGATTGCATTATATGCTAATAATTGGG
CTGACTATATATACCCAACAATTAATGTTGTTATCGTTGTTGTGCTTGTC
TAGTGAATGATGGCAGATGTTGTATTTCAAGGTATGGGAACTGCGTGGCA
ATTTCTGAACGTGATTATGGTCATAAAAGACAAAGTTACGTTCAAAACAG
CATTGGAAAACCTCCAATCCATTCTAATACGCAGCTTGTTTCTGATTGTT
CCAAAGTCCACAGCTTAAATTTTGTGGGCCAGGCATCGTTACAATGTTAA
ACTAAAGGCATTTACAAAGTCATTTCGGAATATTTACTCCACGGTCATGT
TAGCTCAGATTGCAAGAGATCAAAAAGAGAACCGTAGGAGTCAAATACTA
CTTGCCTACAATAATCCTGCTCAGTCTCATAAGATTCTAAGTATTGTTGA
TATATATTAATATTAAGGGTCTATCTGGATAAATGTATTTAGAAGTACTA
CTAAAAAAATCCATCTCAAAGCAGAAAACGCCCTTATTAGCTTCACAGCA
AAGACAGAAATCCACGTCAAAAACATTAACAACGTGTTTTCAATTGCCTC
CCCAGGGTCGAAGCACGTTTTCTCAACAACCCTAAGCAATGTCTCCTCTG
ATCTCTTGCCATCTGAGCTTGCATGTCGATGGCAAATAGTTTCCCGAGCT
CGTCGAAAAACCGGTCCAGTTTGTCCTTGTAACAAGCCCTAGTCACAAAG
TGTAGCCACCGGATTTTTGAACACTCGAAAACAAGCTGTGTCCCCTCCTC
CATCTTTCTGATAAACGATTGGGAGTTCCTCCTTCGGAAGCTGCAACTCG
TTGTTTTTCTGTTCTATCTCCTTGATCACCGGAGATATAGCTACTAGAGT
GGATATTGGAGGTGCACCAAAGATGATTTGAAGCAAACCGTTTTGTTTTT
AAGTTCCAAAACGGTTCCCAGCAACTCGTTGAACACAGCTCCCACTGTTG
CTTCTATTAGTAGTGCCATGATATTCACAACAGAAACACGCACCCACAAG
GATGAAAACAAGATGAAGAAATAAACCTCTCTTTATAATATATAGAGTCA
GGTTAAACGTAATGTTAAAAAGGAAGTTTCTTGGAACTCCATTTCTATCC
TGTTGACTTTACGAACTTGTAGCTAGGTATACTTGTTTGTATTATTTACC
GACTTGAACATATTTTAATTATTTATTTAATTAACTGAATAGTTATAATT
TCCTTAATAGATGCGAGATGCCAAATCTTGTTCCACCCTCCAACCCCAAG
GATAATTAATAGTTAAGTGTGAAATAGTATGTGTGTGTCTATCTATATAT
ATATTATAAAATTTTTTATACAATTATCTAATTATAACATATTATTTATG
TGAGAAATTTATTAATTTTTTAAATAATTCAAATGATAATTTATAATCAG
ATGACCGTGTCAAATTATTTTATACCATCAATGAATAAACATTAATCTCT
CTCTCTCTCTCTCTCTCTATATATATATATAAATTCTAATCAAGGTTG
GTTGAAATTATCTTACACTAAAACTACCATTATTCTTATTCAAGAGTATT

FIGURE 26R

TCATGATGAAGGTTGGATTTTAGGAGAAAAATTCCTAAAAATTCCTTTTT
TTTTTTGTGCAAGTAAAATCTAAGAATTCAAATTGAATTTTATCATTGGA
GCAAAAAAATGATAGAAGTTGTTGCATTCTATATAGCATCATATGACCCAT
AAAAAATAATCCAAGAATCCAAAAAGGATTCTTTAACCAAAGATGCTCTA
AGAATCTCAATATTTTCTCACTTAAGAAACATAACTATCAAATTAATATA
CTATGAAACGAGTTTAATCTTTAGTGATTTACTTGAGACAAACTATATGC
ACTACTGGCATAATAGACTTTAATTCTAAAGAACAATACAAAGACAACAA
ACATGTTCCGGAAAAAAGCTTCCTCAAAATGGAGGCTACTTCAATTTAGA
ACACTCACGTGAAGTGTATTGTATAACATGTCTCCTTAGGTCAGAATGAG
AGCTTTTTATTCGTGCTTGAAGCACGCCCCCTTCAATTTTTACAAGTCGA
GGTCTTTATGTTGTATCAAAATGTTCAATCATATCCAGCTAATGTTGTCG
TGCAATTAACTTTATGATAGTTGTCCCTTCATGATGACTAACTGTCGTAC
CATAAACAATTCATTAATCCCTTACTTTTGCTAGCGAGAAAATTGTTGCT
GCAGTCCACTGTAATATCATTTGTTGCAAAAAATTTTGCAACGATATTTA
ATGTCACTACCACTCTTAACGCTTTCGCAACAAAAACTTCTACTATTTGA
TAACTACGAAAATTAGGCTTAATTGATAGTCAAATTTAACTAAAAATGAT
TAGAATTTCTTTATTTTATTATTATTTTTAATAGAATAATGAGGATTTTA
ATATCATTTTAATTCTTCTTTCAAGTTTTTAATTTCTCCTCCTCAGTAAT
CTAGATTCCATAAGATACTTCTTGAAGTGCAGCTATGATTTTTTTTTTTT
TGTATTTTACCATTCTTTTCTTAAAATTATCATACATAATTATATATGCT
ATATACTTGTTGTTAGGGAAGAAGATAAAAGTTGGTTTTCGAGGATCAGG
GCCTCCACTGAGAAAAGGATAAGGGAAGGAACAGTTGTATATTCCATTGA
TTGATGCTGTTATTACATAATATTATTTATACTGATTTCTCAATAATCAA
ATTTGTCTTTTTGTGCTACAGAATATCAGCAAATGGTTAAGTTTGTCTAC
CCCTACAGTACAGTGGCGGATTCAAGATCCTAAGTCAGTTGGTACAAATT
ATAAAAAATAAAATCAGTGGGTTCAATTATATAAATATAGATGAAATAAA
ATATAAAAATATAAGATTTTATTTACAAATTTCGTGAATTTTAAAAAATG
AGGGGATGCAAGTGCACACCCTCAGATGGCTGTAGGTCCGTCATTGCTTC
CAGATATGGTGCACCTGCTTGCAATCCTTGAGCTAAGTGGGCCTTGTAAT
TGCTCTCTTGGTCTTGTTTTCTAATTGCACCCTTTTCTGTTGCTTGCTTG
CTGCATTCTCATCCTCTGTTTCTGCAACTGGTTCCTTTGCTACGCTATCA
CTTGTGGTGCCGTTTTTGGCTTTTCCAGTCTTCCCAAGTTCCCACTGATT
CAAATTCCAAAAGTTCTGCAAATAAAATTGAAGAAGAAGCTAGAGGTGGG
AAATACTTAAGTCATTCTCTTGAAAAAGTTGCAGCAATGATATGCAACAA
AATATCACTATACCGAGTCAAGGTAATTATTGTGTTCACATGAACATTTC
TCCCATGAAAATATATATTTTCTGACTTTGTAATCTCTTTATAGTATGCA
TGGAAAAATAATTTTCTGATTTTTTTTCTCTGTAGTGTTATATATTATTT
TTAATCACATTTTCTTATTTATTTAGTTTGTTTCTGATTTGACATCATGT
GAATTTGGAGATTTGGGTTAGAAATATTTTTGGAATTTTCCTGGTTAGAA
CTTGATAGGTCCATAATGAAGGTATATAAAAGGATAGGGAAAAGAGGGAG
AGCGGAATAGAAAAAGAAAGGACAAATGGGCCTCAAAAACAAGACATGCT
TGTGTATGACAGCAGAAAGAATCAGCAGTACAAGTTGCACTAGCTGAAGT
GGAAAAGGAACATAGGTTGACATAATGGAATGGATAGCTTGTAAGGAGAG
TGTACGTAGAGGCTGAGAATAAGTTCTTCCTTAAGAAAGGGAGTGGGTCT
GGGTTTGTTTTTTCCTAATTACCATTCTCAACATCTGGCTTGTATCCGCC
ACTCCCCTTCTCTCTGAGTTCTATTTTTCATACTTGGAAGCCTATTTTTT
TTAATATAAATATAAAATTATGGGGATATCTACCTGTCAAAACTTAATAT
AATATATTAGTATCTATTATTTATTTATTTTATTGATTTTATTTAGTAAA
AATCACCCACTTTTCTTTCCGCATACATCTTTGACATATATGTAAGGACA
TTGAAATCTTTAATTCATTAATATATGTTTTTAGGAATAAATTAACATGT
GTTCTTTCTTTAATTCTATGCGTATGGGTTAACCAATATTCAAACTCTAG
ACCATTTAGTTAAAAAATACAAGTCATTACTATTTGTGTCAATCATTATT
GGTACACTGCACAAGTTTAAAATCTAGTTAGATTTGTAAAGAAATGTTAT
GTTACATTTCAAATGACTTCTGACTTTCTTAGTAGCTAAAAAACTTGTT
TAACTATTTGATAAACAAGTTTTTTCAATAATTTTTAACATTTTTTAAAA
CGTTACTTAAATTAATATTTTTAAAAATACTAGTTTCTAACATTTTATAT
TTTTTTCTTATTTTATCTTTAATATATAAACTTAAATCTTGAATTAGTTA
GATACAAGACTATATCCAATCCCACTTAACTAACCTCAAGAAATTAGATG
TCTTATATAATTATTAAATTTATTTAATACACGTCTTTCATTTTGTAATG
ATAAAAGATTTACTGATAATAATGCATTCCTTTTATAGTATTAATTATTT
TATTTCTATTATGACATTATTTTCTTACTCTAATTTTTAAATATTTTTAC
TTCATAATAAATATAAGAAATGTAATATCAAATATTATATTAAAATTAAA
ATAATTTTAATACGAATAAAACAATTAATCATATTTCTAATTTATGCGTT
ATGTTTTTAAGCTGAAAAATAAAATTAACTGTAAAGATTTGGGTTTAGTT
AAATTTATTCGTAATTGACTTTAGAAGGAGTAAATTGAAATACACTTTTA
AATTAATATTTGAGTTTCTCTATCAAAAAAGGCTATTTGAGTTTTATATT
TTTATTCCGACGTCAAATTCTTTGATATGTATAGACTATATTTGAGATAC
TTTTCGCTTTGAATTTCTATCACGCTCTGAGAAATCAAATATATATATAT
TTCTCTTGATCTTAACTTTAAAGTTTAAAGTGATATGAGATTTTTACACA
TACTAAAACAATTTTTTCTCAAATAATGCATCCATTGATATCCTTGTCTT

FIGURE 26S

TGGGTTTGGATCCAAGAGTTTCGACAGCAATCTGCGTACATCTGGTGCAA
TCCAGTTAGGAAATTTGAACTCTCCCCTGCCAATAGAACATACAAGATCA
TAACTCCTTCTGTTTATCACTTCCGGAGCAGCATAGGCAGGGGCACCACA
TGTAGTGGTGGAGTAATCCATTTATATTCCCATTTTCATCCAGTAGAAGA
TTTTCTGGTTTCAGATCACGATGGCACACACCTCGGCTATGGCAGTAGTC
AACAGCGCTGATCAATTGCTGAAATTATCTCCTAGCATCATCCTGCTTGA
GCTTTCCTTTGGATACCTTATTGAAGAGCTCACCACCTTTTACATACTCC
ATAACAAAGTAAATTTTGGTTTTGCTGGCCATTACCTCGTAAAGCTCAAC
CACATGTGGATGCCTGGTTAGCCTCATCGCTGAAATTTCGCGCTTAATCT
GATCAATCATCCCAACTTTCAGAATCTTCTCCTTGTCAGTAATCTTAATG
GCCACACTCATGCCAGTTATGATGTTCCTAGCATGGTAGACTTTTGCAAA
GGTTGAACAAGGATAGCTCAGATGGAGGCACGGACTCATCAACCTCGGTG
AAGGAATTCTTAACTGTCAAGCACATCTTTCACCATTCCCTGATTTTGGT
GATGACACTAGAGAACAATGAAGAATATGGACTTCTTGGAAAGTTTGAAG
AATAATTAAGGAATGATGCAGCACCTGGTTAGCCTTCCAATTACCCAGCA
GCAGAATATACAATGAAAGACACACCTGAAAGAAAGATGAACAAATTTAA
TAAGTTGGGATCATTGTCAGAGAATATAATCTCCTGAATAAAATTCTTGA
AACTTCTACAAACATAACCAGCATAACAATTTTTATAACTTGTTTCTGAT
GTCATTTTTGAACAATCCCAAAACCATAAGGCATTAGGTGAGTTTTGATC
ATATTTAAACAGGACTGGATTAAAAAACAAAGTATTTAGCACATCAATTA
CATTTCTCTCAGGTAGTCTAGTCGTTTTTAGAGTTCTTATAAATAAACGA
TTCATGACCAAGAAGAACAACACAAGACTAAACAAGTATGACAGAAATGT
AAGATTGTCAAAAATCAAGAATAAATCGAAACCAGAGATGGCCACACATT
ATGCAGAAGAAATAAAATTTAATCAAACAATCAATCAGCAGATGGCAGAA
AGCACACTAATACAACAAAATACATCAATAATGAACTTGAGATTCATAAA
AAAGGAGCATGCAAACAAGTGAGACCTGCATTCTGTTTTGAATTACATAG
ACAAATCAAGTCATTCACACTCATCTGCCCAAATTAATCGTCTAAAGTTG
GGAGAGTTTAATGACACTCGAGAAGAAAATGAAAATTCAGTAAGGTTTCA
AATAAGCAAGTATAAATATAACTGAGTTGCCACCGTTTTCAGATGAATGT
GGTTCCACTTTCCATTACAATCGTTACCGTTTGGCAGTCTATCTACCAAT
TTTCATGCTTGGGTCACATGCACTAAGTTATTGTCAATACATATTGGCAA
CAAATTAAAATTTTCCAGATGAAAAAAAAAGGAAAAAAATTTACAAATTTG
CCGATAAGAGAAAAAGGCAAATAAACACAAACACCCCTCTCACCAAGAGA
GAGCTTAACTCATGAAAATAACAACCATCCACCTATACCAGAATTTGGTT
TTAAAATATCATAATTTTGTACTGTTTATTTTTAAACATGTTATTATTTG
TAAAAATTGACCAAAGGTGCACTTAGATCTTCTCATGCTACACAAAAATC
AAGTTTAATAAACATTAAGAAATATTTGTTACATTTAATAAGGGAGATTT
TCATAATAAAAAAAATTCTGAATTTCAATAAAAATACATTTGATGATCTA
TTTTTTGTAGTATAAAATCTTTGTATAACATTAGAAATTATGAAATGTAA
AGTCATAAAAAGGAATATTGATATACTCTATATTGTTTCTAAGTTTTTTA
CTATCCACTTTGTAGTAGTATTGAATAAGTAAAATTCTATCAAAATCTTT
CACACAAATAAAATCAGGTGAAATCTCAATATTATGATTGGGCAAGATTT
CCCTCATGAATGATAGAATCTGAATTTTATTTGATTCTTGCTTGCTGGTT
GATTTTTTCTTAAGAATTTAACAAATATATCTTTTATATATATATATATA
TATATATATATATATATATATATATATATATATATATATAGATTTTAATG
CATTAATATACTTAGATTAGATACATTAAATTTCAAATTTCTGTAACAAC
CTTTGTGAATTATAAGGAAAGTCTGGTCAACTAAATAAGCTAATTTACAC
TCATGCATACAATCGCTTCACTTGAACTTAACTCAATCGTCATCATCATT
ATTATAGTGAGTTAATAGAAATGCAAGATTCTCATTACTAAAAAAAAATA
GTCATTACTAAAAAAAATAGTCATTCCATAAAAAAATAGCTATAAGAGGT
CTTGTTAATAAATATTCTTAAATACTAAGAAAACTTAAAAATATTAAATA
AAAATATAATATTAGTATATTAAAATTGTTTGAAATTTAATTTATTATTC
AAACAATTTGCTTTTTTAAAAATCTTAACAATTTCACTTGTTACAATGTG
ACAAAACATTCAAGGAAGAAAAAACAAAGTTAACTTATATGTGGGAGTGA
GAAATAGGACAACAAATGAGGCTATAAAAGTAATATATTGTTGATAAATA
GAAAAAATAAGTTATATAATAAAATTGTAAAACAAATTTAAAACTTCATT
CAATAATATTTTATCATCTATAATAATTATGATAATTATCTTAAAAATCA
TATTAATGATGATATATGAGTGAATGATAATATAAAATTAATTTATACTT
AATGCATGAGTTTAAATTATAGAAATATTCTTAAATATTAAATAAAAATA
TAATAATAGTATATTAAAATTGTTAAAAATACTGTATAGTTTATCGTTCA
AACTTTTGGTCCTTTATTAAATCTTAGTAACAGCTCCCTTGTTACAAAGT
GACAAAATCTTTTGGGTATGAGATTGGTGAGAATTAGGGACAATGAAAAT
GATGGCATGCCAAACATCGCTAAATTGACCTAATGGGGTTAGTTTTACAA
ACTAATTCCCAGAATAGGTCTGTTTTAAAACTATTTTCAAGGGGGTTTCT
TTTTTACGTAGATTCAGCCATGCATGCATGTATATCGCCAGCATGCATGT
ATATCGTCAGCATGCATGGCGAAATACGCCTGCACTGGACATGTGGCTAT
TCCGCCAGTGTCACTGGCGAGATAGCTGGCACAGTTTTTGCCACTTTGAC
TGGAGATTTCGGTGCAGAGGGCGCAGGCAAGGTGCAAAGGGCACAGGATA
ACAGTAGGGCAGTAGGGTTCAGGCTAAGTTGGTTTTGCAATCAGTGTTGG
CGAAACAAGGAGCATATATCGCCAATGGTATTGACAAAATAGGTGTGTTG

FIGURE 26T

TGCCCTTTAAGTAGCAACTTCATGTTGATGCTTTCGTGCTGATGCTTTGT
GCCTTTAAAAATTTCTGAGTGTTCTAAGTGTTTTTAAAGTTTCTCTCAAT
CAGTAATTTCTCTTCTCTGGCATCGTTTTTATTTATTTGAAGTAATTATT
TTGAGTCTGGAATAAAATTTGAGTTTCGACTGGCATCATTTTTATTTATT
AATTTCTTTGGCATTTTTTTATTTATTTAAAGTAATTATTTTGAGTTTGG
AATAAAATTTGAGTTTCGAGTATTTTTTGTAATTAGATTTGTTTATTTTG
AAGTTATTAATGTTAAGATTAATTATTTATAATAACAACTTCTTTAATGA
TTTGTTCTGCCTTTAAAATGTCTACTTTCAAAGGTTTCCGTTCTGCCTTT
AAAATTTTTACTTTCAAAGCGTTCAAGTTTTTTAAGTTtCTGCATCATA
TAATTAATTTTTTTGTTAGAATAAATTTTTAATCTAAAGTTTGAGTGTAGT
ATTTTTTTAATTATATTTACTTATTTTGAAGTTATTAGTTTTAAGATTAA
TTATTTATaATAGCAACTTAGTTGATGGTTTGATGTGCCTTTAAAATTTC
TACTTTGAAAGCGTACAAGTTTTTTAAGTTTTTGGCATGATATTTATTtG
AAGTAATTAATTTTTTTATTAGAATAAAGTTTTAATTTGAAGTTTTAGTAA
CAAGGTTTTTTGTTATTAGAATACCCAAAATAATTTAAAATAACAAAACA
AAAATTTAAACAATATATATTCCAAATTCATACAAACTAACATACCATAT
ATTTGAATAATAACTTAAAATACCTAAAATAAATATAACATCCAAACTTT
ATAATACCTAAAACTAAAACAAATAATTTAATTATGACCAACAGAAAAAA
TAAAACACAAAATTTTTTAACTACATTCCAAGTTTGAAAAAACCAAATAT
GGGCGGGAGAACATGCAGCTCACAAGCTTTTTGTCACCACCAAAGCGTAA
CGTAACAACACCAAACCACTACTAAAAATAAAGGCCTTGTACATCGGTTA
TAACGACCTTTCTACATCGGTTATGACGCGTGGTGGTAACCCGGGGTCGT
TGAATCACAACATCGGTTTTATGACCGTCTTTGAAGGCCGGCTTTTCTAC
ATCGGTTGTCTAGCTACAACCGATGTAGAATGGGTAACTTTCTGCAGCGG
TTCTCAGGCTGAAACGATGTTGAAAGGGTAGATTTCTACATCGGTTATCA
GTCAACCGATGTAGAAAATGAAAGGTTTCTACATCAGTTATAGTTCAACC
GATGTAGAATGACTAGATATGGTAACGTTGCTACATCGGTTATCAATCAA
TCGATGTAGAAAATGAAAGCTTTTTACATCGTTTATCGTAAAACCGATGT
AGTATGGGGAGATTTTCAACATTACCTTGTATTGGAGGTATATTGATCC
TTTCCTTTAGCAATAAAAAAATCGAACACGATGTCCCAACTATACTTAATT
ATTCAATTCAAGAACCTGTGATTACAACAAAAAATTGATTTTCAGGTTCA
AGTCATAACAACTGAGTATAACTAAGAGTTTTCTAGAACTTATTAGTATG
GTACTGTATGACATGGATGACAGGATGCGATTTCTCATCACAGTATAAAC
TAAAAATTCTTATGCATGTGTAGAGGCTACCACTTAATGTTTTCTCATAT
GGCTACTACAAGTCACAATTTTCTTGTGCAATGACTAAAATTTAAAATAG
GAACTATAAGGCACAAAGAAATAGTTTAACCAACGAATTTCTTGTAAACA
TAGACAAAAGTCAGAATGGAAGGACCTCAAAATGACCTGGCAATAGCAAT
TACTAATTTGATAACTTATAATATCATACATTGGGTACAAAATGAAAAAA
TAAAATGTTATAAACATATAATATAAAGAAAATGATAACTTAATCATGTA
ATCATTTTGTTTTCTTCTAAATTTCAAGAAAAATATTGTAAGTAGTATTC
CAAGTGGAAGCAATACCAATCAAGCACTGGACAATTTGAATCTCTGTCAA
GAAAAAATGCTACTGTCTTATGGTATTTCAAGTAGAGATGACTTCTAGCG
TGTCACAGGAAATAAAAACCATCTATTACGAAAGATAGATGTAGAAAATT
AAAATGAAAATAGTACTGTATGCATCAATCACAGGAAATAAAAAACAGG
CAAGACCCTCGATAtTGTTCATCTAACACGTGCAAAATATATTATTATAC
TGTATGAAGTATTTTGATCTGGTAGTATAATTAGGGTCAGTGCTTGAGCA
GTTCAGAACAGAGCGCTGCAGTGCAATAACCAAGACAACAAGGACTGACT
TTTTTTGGTTGCACAATAAGTACTGTCTGACACTATGATTGCCACAATAA
ATAGTTTAAGAGCAAATTAGTAATAAATGTCAGTTTGATTTAAACAATAG
TATTACACTCCTGGGCTCAGTGGGCTTCATGCATCGAGCCAAGTCCAGCG
AACGTGTAACACGCTCCAAATTTTATTTAATAAATTTGTTACTATTTAAT
TTTTAAGTATTATTTTGTGCAAGTTGAAGCTTCCTCAGTTCCATAGCACT
ACTATAGCAGCAATGCTTAACTAGACACTCAGAAGTTAAAATAGAAACCT
GAACTATTAAGTAATAAAAACCAGTTAACTGTTATAAACACCTTCAGAGT
ATATCAGTATATTCCATATACCTAGGCTTATTTTTTTGGAGGCAAGAAGT
TTCTGGTACTCTGCTGCCTCTGATTTTGCTTTGGCAATTCTCTTCTTATC
TGCAATCCTTGCCCTCTTTCTTTGGAGGGTCAGGGGAGTGACCAGCCGTT
GTATCTTAGGACCTTTGCTCACCTTTTTCCCTACAACCAAACATATGCAA
CTCAGACTAGAAATCATCACAATCATGTCCAAAAATAATCTCCTTCAATG
GGTCCTACCCATCAAACAACAGCATAAATATGCAAAACAAAGTTTTCAAA
TTTGAACGAGAAGTGATAGATCATAGGAGATAACCTCTTACGATACATGT
ACTAATTTTTTAAGATTATCAAAAAGAATGACCTGAAGAAAACACATTTT
TATCAGAAGTCCTATTTTTGCTACACACACAACTCTGAATGGATAATTTA
GATAAATTCTTACTGCAAACAAAATATATATACAGGACCACAGATAAATT
TCAAAAGAAATTTTCAAAAACCAGATAAGCTCTGTTAATGTGGTCACCTT
AAAAAAAACAATCCATTATTAAAAAAAAAAAACTTACATAACATCACGTA
AATTTATATATTTCATAGAATGATATAATTTTTTTTGTCTCTATCAATTA
TATGAAGCTCTATAAGCTTGTTCAATGGTAATAGAGGCAATTAGAAGGTA
AGACATGCATGTGTACTTTGTGAGAAGTTAACCAACTAATTCATTTGTTG
TGACTTTGTTAAAAAAAATAAAAATTGTGAAGAACGGCTTCTCTGCCAAC

FIGURE 26U

ACAACCAACTTTAGTCAATTAGGGTGTGTTGTTTGGAGAAAAAGAGGATA
AAAGAAAGTAGAAATCAACAAAGTGAGATTCACATTTCTACACTTTAGTT
TTAAATTTTTATCTCACTTTAATTTTTTTTTTCATTTCTTTCCACTAACA
GACCCTTAAAAAATTGAAAAAATAATGTGGACAATTTAGTCAACTCACTA
ACACTATTATAAGCAAGTGGGTTTTAAATTTTGAAAAGCATTACGCAATA
AAAAAAATTAAATGTTAAACTACAAATCATGAACAAAATCATATATGGGA
TTTACTAGATGAGAAAATCCATTGTTTAATTTCCTTGAAAAGGAATTATT
ACTCGGGTTTTTTTTTCTAAGCAATTAAGCAAAGAGATATCATTAATAAA
AAAGCTAGAAGACTGTACAAGATTTACCTAGGCCAAGTCATAAGACAACA
TACAAAGTTTAGAAGCAAATACATCAGAACATAAAAAATGCAGTAAAAAC
CAGGATCATCCTTTACCAGTAAAAACCAGGTTCTCATCCAAACTTGGCCT
TGTTCCTCTCTTTCTCTTTTCGTGTACCCGTTGCTAACCACGAAGCTTGA
TGACCATGACATGACCAAAAATAAAATATATCAGAAAATGATAAGGTCGA
ATAATACGTTAAAGGGCAAGGTAGATCAGCAGTCGTAAAAAGTACTTTTT
TTAGTAGTGGAAGTCTATAGTTGTATACCTCTCAGAGCAAAACTACTTTC
TATTACCATCAAGCGCTTGTTTCTTTACAAATTACATAACTAAACTTGCC
CCTCTTTATATTCATTAGTATTTTCAAATTTCATCCTTTCATCTTTTGAC
TTTTAATGCTTCTTTTTCCTGTTATTAACATTGCTTGTTACATGTTTTTT
TAGTTAAGGGTAGTGGATTGATTAATAAGTTAAATAGTTGAATAGTTACT
AAAAAGTTGTATAGATACTAAACTTGTATAGATAGAACATGTATCTTTGG
GCTTATTTTAACTAATTACATTTAGTTGATTTTTTTTCTTCTCATTTATT
ATTGTCTTTTTTGGCTTAATCGTGTTTGTTAACAGTTGTGGTGTGAAGTA
TTAATGAGGATGGGATTTGAAGCTTCTTTACACGGTTTGGTTTTGTATTT
TGCAGACAAATTCATTACCAAGGCAAGGACCAAACACAGGTCTTGCACTC
CAGCTACCAAACAATGCACCTGCCTGGCAAGGTCCTAACACAGGACTTGC
AATTCAGCCCTCAATCTGGTGTACAAAAACTTGTAATACATTTTTGTTTC
CAGGGCGTATTTCAATCTGTTTGTAAGATTTTTAAGATACTCATATCTGT
CATACACAAATTCTCGTGTAGTTGTTTGAGTATATAATGAAAGTGTTAAA
AAGTTTCATCTATTACATATTTGTATTAATGGAGGGAAGAAGAGAATTAG
GTTTTATGTATAGGATAGGATAGGATAGAAGTATATGTAGAAGTTCTTTT
TGGTTTTACTATATCAAATTAGATGTTTTTTGTGAATTGTGATGAATGTT
GTCATGACTTAAGGCTTAAGCACAGCAGGATTGGTCAATAACAGTAGTTC
ATTATGTGGAAAAACCCCGAGGCTTAATTACCACATTAACATCTTATTTT
GCTCAATGTAAGATTCACAACATTGCTACTCCCTTTAAGAAACATGTTCA
TGGTGGCTTCGCTCTATTTCCCCTTACATTGGCAGACTCTCAAATAATAA
TTCAGTACATTGCATCTTACTCTAGCCTATAATTAGGTATTTCAGCAGCT
AAACTCTGAATTACCACCCATGGTGCCTTCACTTGGTTCCCCTTACATTG
GTGGGTTGACACACCAATGTATGCAGTAGATTGCATATCATAACAGCAGA
CCAATAAGTTGATTCTCATTCATTCTCTATTGTCATCATACTGTCAATTT
GGGTCTGCAAAAATGTCTACCCAAATACACAAAATCTTACACAATTACAA
GCTTGAGGAATTGACTTCACTAAATTAAGGCACCCAGCAAAAGACAATTG
GTGAGCCTTCCAATTAGAGAGGTGTTGATTCACTTTATTTAAAATAAATT
GAAAGGAATTCCTCTACACTTTTTTTATGAAAATTGGGATTCCCAAATAC
TCTACCAGGTCATCAGTATGTTGATACCTCATTCTCTGCCAAATAGCCTG
CTTTCACTGCCATCCCACATTATTAGAAAAATAAATACGGGTATTATCAT
TACTAACCTTTTGGCTTGAGCTCTTAGAAAATAGGTCAATAATATGAACC
ATCATCTTCACTTGTTCCTCACTAGCTTCCGCATAAAGGAGAAGGTTATC
AACTAACGCCAGATGAGACAATTTACGTGTTCTTTTAACTATCTGAATAG
GCTTCCACTGTTTTGCATCAATAGCAATTTGAATTAAGTGAATGATGAGG
ACATGACCAAGAGCAAGGGCAAGGATCCACTTGAAGGACTTGGAGGACAT
ATGACAAGGGCTAGAGCAAGGAAAGCCAAGGAAGCTCTTCAACAAGTACT
ATCCATACTATTTGAATACAAGCCCAAGTTTCAAGGAGAAAAGTCCAAGG
TTGTGAGTTGTATCATGGCCCAAATGGAGGAGGACTAAATGGCACCACTT
TGTCTCAATTTTAGAGTGTTTAGTTTGTCTAAATAATGGCTCAATCCTTG
TAAAGTTGGTTGACCATAAATATGTTTTGGGTTAATCAACTAAAAGAGCT
TTAGTTTGGTTTAGTTCAAGTTGTAATAAGGGCCCAATTGGCAACCTAGG
CATCAGCCTTTTGGGAGACCAAATGGTGGCTAGCTTGATGGCTGTTGGGG
GTGACTTTTGGTTGCCACAATTTTAGTTACACTTAGCCATTAAGTTCTTT
TAATTCCCTAGGTTAGTGGCATTAAGTTCTTTAATTCTAGGTTAGTGGAT
CATTACTAAAATCTGATGTAAAGCTTTTATATAAGCTGAACCATTTTATC
AATAAACACAAGTTGAGTTTTATTCAGAAAAATAGAGTTTATCTCTTTTA
TCTTAGTGAGAGTGATTCTCCTAAGTTCTTGAGTGATTCAAGAACACCCT
GGCTATATCAAAGGACTTTCACAATCTTTGTGTGTTTCCCTCGCCGGAAA
GAGTGATTCTTTCCTTCCTTTCATCTTCAACCTTGTTCTTTCAAACCACA
ATTCCAAAAAATCCACTTCTGCCCATAATTATCTCGTGGCCATAACTCCT
GTTTTACGCGCTCAAATTAAGTGATTCTTGAGCCTAAATTGAATTTCAAA
ACGAGATCTTTCACCTCGTTTTGGAATCACCTCATTTGGAGCCCTGTATC
TTGAGTTATTGCCATTTCTATATTTCTGTCCAACCACCACTTAACCTACG
TTTTATCATCTCATTCTTCCATTTTATGCCAAGAACCACCTTATTAAGGC
CCACGAAATTAGCCACCGCTCAACCCTTAAATCTTGCAAATTTTCCATCC

FIGURE 26V

TTTCCTTAATCAATTTCCGCATTTTCCATCAAGGTTTAATCCTAGACAAT
CCTTAGTCAGCCTTTGTGCAATGAAGGTTCATATCATTTGGTATCAGAGC
CAAGTTCTAGGATCAACACTTCCTTTGCTGGAAATATTGGGTAACATCCC
TTCTTTATTCTCTTTGCCATTTATATTACCTTCTTATTCATATTTTTTTA
GGCTGAACCATTGCAAAAGTTAAGCCTTTTGATCTCTTTGTTATATATAT
ATTAAAAAAGCAGAAATTCGTATAAGCAAAATTAAAAACAAAAATTGGGC
TGAATGGTTCATGCCTGAAGAACTTAAAAAATATATATATTTAAGGTAAT
ATATTGGTAGCATGAAGGATTGTTACTTGAATTCCTAAATTCTGAATTTT
ATTTCCTTCATTTGTGCCTAAAAACATTGTTAGCCTTTTTCTTGGTTAAC
CTTTTCCTTGTCTCTCTAGCCTTACCTTACACATATTGGTGAATTGTTCT
TTGTTGTGGCCATAATCTCTTGAATTGCCTAATAACTCAAGGGGAATTAG
AGTGGTAAAAGGCAAGAGTGTTTCATTAGAGAAAAGCCATAATTGTGTGA
TACACTTGAGTGGGTGAGGTATTCAAACAACAACTATAATTGTATTGTTA
TGTTTGATTTGTTTGTTTGAGATGACAGGAACAAATCCTAATGATGAAGT
GGGGCTTTCGCAATTCCAAATGCAAGCTTTGATGCAACATTTGGAGAGGT
TAATGAAACAACGAGATGATGCACTCCATGAGAGGTTGGATCAAATGGAG
AATAGAGATCATAATGAAGAAGAAAGGAGGAGAAGAGGGAATGATGGTGT
TCCTAGACAAAACCGAATTGATGGTATTAAACTCAACATTCCTCCCATTA
AAGGAAAGAATGATCTGGAGGCTTACTTGGAGTGGGAGATAAAAATAGAG
CATGTTTTCTCATGCAACAACTATGAGGAGGACCAAAAGGTGAAGCTTGC
CGCCACGGAGTTTTCCGACTATGCTCTTGTGTGGTGGAACAAGCAATGGT
TGATACATGGGTGGAGATGAAAATGATCATGACGAAGCGGTATGTGCCGG
CTAGTTACTCAAGGGATTTGAAATTCAAGCTCCAAAAACTAACCCAAGGC
AACAAGGGGGTTGGGGAGTATTTCAAGTGTCATACCCTAATTTCGTCCGG
GAACCTTTGCTCGATGACATGCGACCATTCTTTGGTCCTTGTGAGGTGCT
TGGCACCCATCATTAGGCAATTTATGAAATTCCAGGACATGCCGAAAAAC
CAAAAAAAATATTGATGCACAATCCGTAAGTTTCCGTGACACACCGGAAA
TCAAAAGGAAGCATCGTTGCATAATTAAGTGAGGTTCCGTAACATTCCGT
AAGTCAAAAAGGGGATGATTATGTAATCCGCAAGGTTCCGTAACATTACG
GAAAGAAAACAAGTATCGTTACGAAATTCGTAAGTTTCCGTAACTTTACG
AAAAAAGAATCACCAAAAAAACAGCAGAGGGGGTGTATTTAGTAAAAATG
GGGGTGCAAATAGCACCCAGACCCACTTGGGCCCTCCAGAAGATTCCTCC
AGAAGGCGGTTGCTTCTGGAGGAAGCAACCCTGCTCGCCTGGGCGAGCTG
GGCGGCAAGCATCTCCCCTATTTTGCTATAAATAGGGGAGAAAATGAAGA
AGAAAAGGATCCCAGCCCTTTAGGCACTTCTCTCTCTTTGGAATTTGCTT
GGAAAAATTGTTTCCGTGAAGAAAATCTAAGCCGAGGCGCTTCCGAAACG
TTTCCGTAACGTTTTCCGTGAGGAATCTCGCAAAGGTTTGAACCGTTCTT
CGACGTTCTTCATTCGTTCTTCATCGTTCTTCGATCTTCAACGGGTAAGT
ACCTCGAACCAAGCTTTTCGATTCATTCTATGCACCCGTAGTGGTCCACA
TTGTGTTTCGTGCATTTTGATTCTCATTTTGTTTACTCTTTATACCCCCT
GTTGACGTGCTTAAGCCATTTTACTTAAGTCGTTTCTCGCTTAACTTAAA
AATAAAATAAATTTCCACCGAACGTTTGAATTGTATTATCCATTAGCTTC
GGTTAAAATAAATTCCGACCGTTCGGTCATGCCCGTACCACGTTGGAAAT
CAAAAAGAGGTAAAAATATATAATAATCAAAAGACATCTTTTAGTAAAAT
AAGCGGGAAATCAATCGGACGTTTTCTCTTTGGGATTTCTCATTCTTAAC
CCGATTGATTATAACTAAAGTGAAACCTAGGGCTACATCACTCGCCTAGT
CAAGCTGGTCCACAAAAATAAGCTTTTGAAGTTTGTCATTCACATTTCTC
CTTAAGTAAAATGGATCATTTTAAAGGTCCAACGCGTTAAAATGATCACC
CACTTAAGTAAAAAAGAATCACTTGATAAGAAAGAACTACGTAGGTCTGA
TTTTCTCATCCCAAATTGAGGAATACGTAGGAGCAAAGGGAAACACCCTT
GTCGACCACAAAAAAGGAAAAAATATAAAAAGGGTATAAAGGATATAAGA
ACATAAAAGGGAATAAAAAAATCAAAGTCATGTTTGCACATTCGATTAAA
GGCTGCCGTCCCTTGGGACGGGCGTGTGGGGTGCTAATACCTTCCCCGTG
CGTAAATACAACTCCCGAACCTTTCAAACTTAAAAATTCGTAGATCGCGT
CTTTTCCGGTTTTTCCGACGTTTTCCTCAAATAAACGTTGGTGGCGACTC
CGCACGTATTCCTTTCGTGGAACACGCATCCCGCGAGTCACGCGTCGCCC
TCCCGCCGAAGGGTAGGTTGCGACAGTTGGCGACTCCACTGGGGACCTGT
TTTAGAGAGTTAGGCCATTTAATCTTGTGCAATGTTTTATCATGACTTTC
TCCTTTGTTGGTTTCCCTTTATTTGTCTTATGTTCTTGTGTATATAAACT
ATTTGTTGCTTTTAGTGTATTTTAAAATGTATGCATGAGGTAAATATTTA
TTCATTTGATGCACACAAACACCAACACTATTTGCACACACTGTGAGTGA
AAAAAAAAGGGCCCTATACCCGGGTTCGTGGGAACATAAGGAGTGGAGGT
GAATCTGTGATCATGCTAGGTCTCCGACTTGCTTGATTACAGTGAACCCT
CATCTAGAGCTTTTCTCTTTGAAAACCTATTGTTGCTAGTAGTCCCTACT
GCTACGATATGTTCTTCAAAGGGGATGATACCTCTAGAAACCATCAAGAG
AGATATAACTACCTTGGGGATTATTGCTAAAAGCCCTAGTTAGTTCTCTC
CCTTATAGGTCCTTTAAATAGGGGCACGAAGCAAACACGCTGCGTGCCAT
TTTTCACACTGCCATGCATGAGTATCATATACCCTTTTGCTTATGTTCAG
TAAATATTGTCATACTGTGTACGTTCCCGCATTGTGTCTTTTGCATAAGC
ATTGCATACGGATTCTTTCTTGATCCCTACTGTAAACAAACCAACGGAGG

FIGURE 26W

GTCCCGTGTCGCCTTCTTAAAAACGTGCGTTGGCGGCATTTTGCTACCCC
TAGACGTCGTATCTAAGAAGGGGACAAATTCCCCGGACCCCCGCATTCCT
AGATTGCATCTGTGTCATATGCACTCCATCATGCATTCATCCATTCCACC
CATGAGATATCGGAGTTTTGATTTGCACCAGCTTTTATCTCACTTTAGTA
AGCATGGGAACAAATCAAACCGGCAAGAGGTTTTACCAAGTCAAGGTCAA
AAGCCCAGATACCACCAGCATCAAGGAATTAGGGCGGTTGATGGAACCCC
TCCAAATGCAAGCCTTCCGCAAGACTTACGGAAAGATCTTAGAGTTGACC
ATAGCAGAGGTGTCCATAGAAGCCATTGCATCACTTACCCAATACTACGA
CCAGCCCTTGAGATGCTTCACATTCGGGGACTTCCAATTAGTACCAACCA
TTGAAGAATTTGAGGAAATTCTAGGATGTCCTCTCGGGGGAAGGAAACCA
TATCTTCCCTCCGGGTGTCTCCCCTCTTTGAGCAGAATTGCAACTGTGGT
CAAGGATTCAGCCAGAGGTTTGGACCGCATAAAACAGACTCGGAACGGCA
TAGCGGGCCTGCCACAGAAGTACCTAGAAGACAAGGCGAGGGGTATGGCC
AATCAAGGAGACTGGGTCCCGTTTATGGATGTGTTAGCTTTGCTAATTTT
TGGGGTCACCCTCTTTCCAAACGTGGATGGTTTGATAGACCTAGCAGCAA
TCGACGCTTTCCTTGCCTACCACCATAGCAAGGAAAGTCCGGTGGTAGCC
GTCTTGGCAGATCTATTTGACACATTTGACCGAAGGTGCGAAAAGAGTAG
CGCACGGATCATCTGTTGCTTACCCGCCCTCTGTGTTTGGTTGGTTTCAC
ACTTGTTCCAACAAGACACAAGACATCCATGTCCGCTCCTGAGCCATCGC
TCATGTACTGAAAAGAGGAGAATAGATTGGGACCAGCTCTTGGCCGGGAT
AGGAGGTAGAACAATCAGTTGGTTCCCCCGATGGAAGGAAGGAAAAGAAG
GAGTCCTTTCCTCGTGTGGAAGATACCCAAACATTCCGCTGGTAGGGACG
AGGGGTTGTATTAATTACAATCCCACGCTCGCTATAAGACAACTAGGGTA
CCCCATGAGGGGAGCACCGACGGAAGAAAGCATGTCTCCTTTCCTTGTGA
GGGATCTCGGCGCACAAAATTCCAAGACTATACAAAGAATCCATAAAGCA
TGGGAAACCCCGTTAAGGAAAGATCAAGAGCTTAGAGGCATTCGTAATGG
CATCATTGGTGGGTACCACCAATGGCTGAAAGTTCGCATACGAGGTTTAG
ATTGGCTCGCCAAGTTAAAAGTCGTCAGCGAAGAGAATTTTGAAGCACCG
GAAGCGGATGAAGAAGTCCAAGCTCTCAAAAGCGAGTTAGGAAAGGCAAA
ACTCGCCAAGGAGAAGTTCAAGTTGGCTGCTACACACGTTCGGAAGGAGT
GTGCCGGGTTACGGGAAGAGAATGCAATTACCGCAAGGGCCCTTGAACAA
GAGACCAAGAGGGCTCGCAGGGAAGAGTATGGCCGGAACAAATTTCGCGG
AGCTCTATGGGGTAGCAATAATGAACTCAAGTTGCGAAGGGAAGAAAGGG
ACCAGTCGCGAGCACATAGCATGGTTCTGAAAGAGGAGTTGATTACTTGT
TCAAGGTCCAAAAGAAGCTTGTCTCAGCGTCTATGCGAGACAGAAACCAA
CATGTTAGCTATCATCGCCAAGTACCAAGAAGAGTTGGGTCTAGCCACGG
CCCACGAGCATAGAATCGCGGATGAGTATGCCCAAGTATATGCGGAAAAA
GAGGCTAGAGGAAGGGTGATCGACTCTTTACACCAAGAGGCAACCATGTG
GATGGATCAGTTTGCTCTTACCTTGAACGGGAGTCAAGAACTTCCCCGAT
TGTTAGCCAAGGCCAAGGCGATGGCAGACACCTACTCCGCCCCCGAAGAG
ATTCATGGGCTTCTCGGCTATTGTCAGCATATGATAGACTTAATGGCCCA
CATAATTAGGAATCGTTAAAGAAACTTGTATGGTCTCTCAGACCTTGACT
AGATATGATTTCTTTTTTATAAAATGAGTTGGTCCCATGTTTCTACTCC
AAAAAGCTTGTGCAAATCAAATCACTCCTACATCTCATCTCTAGCATGCA
TTTTCTTTCTTTACCCACTCCTCACGTTTGGTTTTTTAGGGAAAACACCA
TAACTAAACGCGCCGCAAGGGATCCCTATCGCACCAGATCCAAATCTAGA
ACGATGGGTGATCAAGAGGAGACGCAGGAACAGATGAAAGCCGACATGTC
GGCTCTGAAAGAACAAATGGCCTCCATGATGGAGGCCATGTTAGGTATGA
AACAGCTCATGGAGAAGAACGCGGCCACTGCCGCCGCTGTCAGTTCGGCT
GCCGAAGCAGACCCGACTCCCTTGGCAACTACGCACCATCCTCCCTCAAA
CATAGTAGGACGGGGAAGGGACACACTGGGACACGATGGCAGCCCTCACC
TGGGATACAACCGAGCGGCTTACCCTTATGGATTGCCGCCCAACTATTCA
CCACCCGTCTTGCAAGAAGATGCGGGCCACATTGCTTCTCCCGTCCATGA
AAGAGAGCCTCCTCAGCAGCCCGACGAAGTCCACAAAGACCCTCAAGATT
ACGCTCGAAGGGATGTCGAGTTCTATCCCCCGATCCCCGGAAGGGCCGGC
ACCAGGCACATTGCCTCAACCCAACATCGCAGCACCGCCAATAGTTTTGT
CTATGGAAGGGCCGCCCCCGGCAACTGAAGAAAGGAGGAAGCTCGATCTC
CTTGAGGAAAGATTGAGGGCTGTGGAAGGATTTGGGGACTATCCGTTTGC
AGACATGACGGATCTTTGCTTAGTACCCGATGTTGTTATTCCCCCGAAGT
TCAAAGTGCCGGACTTCGACAAGTATAAAGGGACGACTTGTCCCAAAAAC
CACCTCAAGATGTACTGCCGTAAGATGGGCGCCCATTCTAAAGATGAAAA
GCTGTTGATACACTTCTTTCAGGATAGCTTGGCCGGAGCTGCGGTAGTGT
GGTACACTAATTTGGAAGCTTCCCGTATCCGTACTTGGAAGGATCTGATT
ACCGCCTTCCTAAGGCAGTATCAGTACAATTCTGATATGGCTCCAGACCG
TACTCAACTGCAGAATATGTTCAAGAAAGAGGGTGAAACCTTTAAAGAAT
ATGCGCAGCGATGGAGGGATTTGGCGGCACAAGTAGCTCCTCCCATGGTT
GAGAGAGAGATGATTACCATGATGGTAGACACTCTGCCAGTGTTCTACTA
TGAGAAGCTAGTGGGTTACATGCCGTCCAGCTTTGCGGATCTGGTGTTTG
CCGGGGAAAGAATCGAGGTGGGATTGAAGAGAGGAAAGTTTGATTACGTT
TCCTCCACAAACGTGAACGCCAAAAGAATCGGGGCAACAGGGGCAAAAAG

FIGURE 26X

GAAGGAAGGAGATGCCCATGCCGTCTCTTCAACGCCCGCATGGGTCAAAC
CCCCAGCAAACACCTCATGGTACCCATCAGTACGCGCAACATCACCCAAG
CTTCTCGGCTCCTGCTGGGAACGCCTCTAGCTCAACACCCGTACAGCCTA
AGGCACCCACCCAGAGGGAAGCTCCCCAAGTTCCAACTCCGAACGCGACT
CGACCAGCCGGTAATTCCAACACGACAAGGAACGGCCCTCCGAGGCCGTT
GCCGGAATTCACCCCGCTCCCAATGACGTACGAAGATCTTCTACCATCCC
TCATCGCCAATCATTTGGCCGTGGTAACTCCCGGAAGGGTCTTCGAACCC
CCTTTCCCGAGGTGGTATGACCCTAATGCAACTTGCAAGTACCATGGGGG
CGCCCCGGGGCATTCCATCGAAAAATGCTTGGCCCTTAAATACAAGGTCC
AACATCTAATGGATGCCGGATGGCTGACTTTCCAAGAGGATCGGCCCAAT
GTGAGGACCAACCCGCTCGCCAATCATGGAGGGGGGGCAGTTAATGCAGT
TGAATCCGATAGGCCCCACAGGTCTAAACCGTTGAGAGATGTGGCAACCC
CTAGGAGGTTTATCTTTGAGGCCCTACAGAAGGGAGGTGTAATTCCCCAT
AGTGGGTGTAAGGAGGATTCCTGTCTGCTACATCCCGGCGAGATGCATGA
CATGGAGACGTGTTTGGAAGTAGAGGAATTGTTACAATGGATGATAGACC
AAGGTCGACTAGAAGTCGGCATTAAAGGAAAAGAAGAGCCGCATATATGC
ATGCAATCTACGGAGGGGAGCGGTATTGCGAAGCCCAAACCCTTGGTGAT
ATACTTTACTAAAAGTGCAGCCTCGCAAAAGCCTGGGCATCCCTTAATGG
TCAAACCTGTTCCTTTCCCGTACCAGAATAGTCACGCGGTCCCGTGGAGA
TATACACCTCCGGAGAAGAAGGAAGAAGAGGTCACAGACATCAGCTCGCT
GTCGGCTAAAGTAACAAATATCACGGGACTGAGTGGTGTGACCCGTAGTG
GTCGTGTGTTCGCACCTCCGGACCTACCGGTCCAACCCGCCGACGTCAAG
GGAAAAGGAAAGGTGGTGGAGGAACAAGATGGCGAAGCACCCCACGCTTC
GAATAAAGATATTCCAGCAAAGGGGCCCCCAGAGAAAAGGGATGGTAGAA
AGGAGGTGTCGCTAGAGGAAGCCAGCGAGTTCCTTCGGATAATTCAGCAG
AGCGAATTCAAGGTTATCGAACAGCTCAACAAAACCCCGGCTAGGGTCTC
GCTGCTAGAGTTACTTATGAGCTCCGAGCCTCATCGGGCTCTGCTAGTAA
AAGTGCTGAACGAGGCTCACGTGGCCCAAGATATTTCGGTAGAAGGTTTC
GGAGGGCTGGTCAACAATATCACTGCCAACAACTATCTTGCCTTCGCCGA
AGAAGAAATCCCCGCCGAGGGGAGAGGGCATAATAAGGCTTTACACGTAT
CAGTCAAGTGTATGGACCATATCGTGGCCAAGGTACTTATCGATAATGGT
TCCAGTTTAAACGTGATGCCTAAGAGCACTTTGGACAAGTTACCATTCAA
TGCTTCCCATTTAAAACCAAGTTCAATGGTGGTTCGGGCCTTCGACGGCA
CTCGCCGAGAGGTTAGGGGAGAGATCGATCTCCCAGTACAAATAGGCCCT
CACACCTGTCAAGTCACCTTCCAAATAATGGACATTAACCCACCCTACAG
TTGCCTGTTGGGGGCGCCCGTGGATCCATTCAGTGGGTGTTGTGCCTTCT
ACACTCCACCAAAAGCTGAAATTCGTAGTGGAGGGGCACTTGGTCATCGT
GTCAGGCGAGGAAGATATCTTGGTAAGCTGCCCATCCTCCATGCCTTATG
TGGAAGCCGCAGAAGAATCGTTAGAAACCGCTTTCCAGTCTTTTGAGGTG
GTCAGCATTTCCTCCGTGGACTCCCTCTTTGGGCAACCTTGTCTGTCCGA
TGCGGCGGTAATGATGGCCCGAGTTATGTTGGGGAACGGTTATGAACCCG
GGATGGGTTTAGGCAAAGACAATGGCGGCATAACTAGCCTGATAAAAACC
CAAGGAAATCGTGGGAAGTATGGTTTAGGCTATAAGCCCACTCAGGCAGA
CGTGAAAAGAAGCATCGCGGGAAGGAAGAACAGTGGTCAGAGCTCGCGTT
GGAGACAAGAAAGTGAAGGAAGCCCGCCCTGCCACATAAGTAGAAGTTTT
ATAAATGCGGGTCTGGGAGACGAAGGTCAAGTGGTCGCGATATGTGAAGA
TGATGTTCCAAGAACTCTGGATTTGGTCCGACCATGCCCTCCTGATTTCC
AGCTGGGAAATTGGCGGGTGGAGGAACGCCCCGGCATTTACACAACAAGC
ATAATGTAAACCTTTACGTTTTTAAAAGCTCTATAGTTGGGCCTAGGCTT
TAGAGTTTTCATTTTGTTAAGGCTTTGTGTCTTTTGTCTTTGAATTTATA
ATACAAAGATCTTTCTTCATCTGTTCCTGGTCTCTACCCATTCTCATTCA
TTTGCATGTTTACTTCTTTTTCTGAAACGGCAGATCCGATGACGAGTCCC
CCGAAGGTACTAATACCTGGGACCCGTCTATCAATTTCGAGCAAGAAATG
AACCAAACGGAAGATGAAGGAGATGAGGGGGTGGGACTTCCTTCGGAACT
AGAAAGGATGGTTGCCCATGAGGACCAAGAAATGGGGCCTCATCAAGAAG
AAACAGAGCTAGTAGACTTGGGAATTGGCAGTGGAAAGAGGGAAGTAAAG
ATAGGTGCAGGCATTACCGCACCTATCCGTGAAGAATTAATAACCCTGCT
AAAAGACTACCAAGACATCTTTGCTTGGTCATACCAAGATATGCCCGGTT
TGAGTTCTGACATTGTGCAGCACCGATTGCCTCTGAATCCCGGGTGTTCC
CCAGTAAAACAGAAATTGAGGAGGATGAAACCCAAAACGTCCTTGAAGAT
AAAAGAAGAAGTGAAGAAGCAGTTTGACGCTGGATTTCTGGCCGTCGCTC
GGTATCCAGAATGGGTTGCCAACATCGTACCAGTTCCTAAAAAGGGTGGG
AAAGTACGAATGTGTGTAGATTACCGGGACCTGAATCGGGCCAGTCCCAA
GGACAATTTTCCGCTACCACACATCGATATCCTCGTAGATAACACGGCCA
ATTTTGCTTTATTTTCCTTCATGGATGGTTTCTCTGGTTACAATCAGATA
AAGATGGCACCCGAGGATATGGAAAAGACTACTTTCGTCACCCTGTGGGG
AACGTTCTGTTACAAGGTGATGTCCTTTGGACTCAAGAATGCCGGGGCAA
CTTATCAGCGGGCCATGGTAGCTTTGTTCCATGATATGATGCATCAAGAG
ATCGAGGTCTACGTGGACGACATAATTGCTAAATCTAAATCTGAGGAAGA
ACACCTTGTCAACCTGCGGAAGTTGTTTGAAAGGCTTAAGAAATATCAAT

FIGURE 26Y

TAAGGTTGAACCCCGCTAAGTGCACCTTTGGGGTCAAATCAGGGAAATTG
CTTGGTTTCGTTGTAAGCCAGAAAGGGATAGAGGTAGACCCCGAAAAAGT
GAAGGCTATCCTTGAGATGCCGGAACCCCGTACAGAGAGGCAAGTCCGAG
GTTTCCTGGGGCGCTTGAATTATATTGCCAGATTCATATCGCAGCTCACA
GCCATTTGTGAGCCGTTGTTTAAACTCTTGCGCAAAAACCAAACTGATCG
GTGGAATGAGGATTGCCAAGAGGCTTTTGGAAAGATCAAAAAGTGCCTAA
TGAATCCTCCTGTGCTTATGCCACCAGTACCTGGAAGGCCTCTCATTTTG
TACATGACAATCTTGGACGAGTCAATGGGGTGTATGCTGGGGCAGCATGA
CGAATCCGGGAAGAAAGAGCGCGCTGTTTACTACCTAAGTAAGAAGTTCA
CGACCTGTGAGATGAATTACTCCTTGCTCGAAAGAACGTGTTGTGCTTTA
GTATGGGCGTCCCATCGCCTAAGGCAGTACATGCTGAGCCATACTACCTG
GTTGATATCCAAAATGGACCCGGTTAAGTACATCTTTGAAAAGCCAGCTC
TCACAGGACGAATCGCCCAGTGGCAAGTCCTGCTATCTGAGTTTGATATA
GTCTACGTCACCCAAAAGGCGATAAAAGGAAGCGCTTTGGCAGATTATTT
GGCTCAACAGCCTCTTAACGACTACCAGCCCATGCATCCGGAATTCCCGG
ATGAGGACATCATGGCCTTGTTCGAGGAAAAGTTGGACGAAGATCGGGAC
AAATGGACTGTATGGTTTGACGGAGCGTCAAACATTCTAGGTCATGGCGT
TGGGGCAGTGTTGATCTCTCCGGACAATCAATGTGTACCTTTCACAGCCA
GGCTAGGATTCGACTGCACCAACAACATGGCCGAATATGAAGCATGTGCC
CTAGCCGTCCAGGCAGCAATTGACTCCAATGCCAAACTACTCAAGGTGTA
CGGCGACTCAGCGTTGGTAATCCATCAGCTGAGAGGGGAATGGGAAACTA
GAGATCCCAAGCTGATACCCTACAAAGCCTACATCAAGGAATTGGCTAAG
ACTTTCGATGAGATCTCCTTCCATCATGTTCCCCGCGAGGAAAATCAAAT
GGCGGATGCACTTGCTACATTGGCATCTATGTTCCAGCTAACACCGCACG
GGGACCCTACCCTACATTGAATTTCAGTGTCGTGGCAAACCCGCACATTG
TTGCCAAGTGGAAGAGGAACGGGACGGAAAGCCCTGGTATTACGACATCA
AGCGATATGTCGAAAGCAAAGAATACCCGCCGGAGATTGCCGACAACGAT
AAAAGGACATTGAGGAGGTTGGCAGTCAGTTTCTTCATGAGCGGAGGCAC
ACTGTATAAGAGAAATCACGACATGACACTCCTGCGATGTGTGGATGCCA
AGGAGGCAAATCACATGATCGAGGAAGTCCATGAGGGCTCGTTTGGAACA
CACGCCAACGGGCATGCTATGGGCCAGGAAGATCTTAAGAGCAGGTTATT
ACTGGCTTACCATGGAAAGTGATTGTTGTGTCCATGTGAGGAAGTGCCAC
AAATGTCAAGCGTTCGCAGATAATGTCAATGCCCCACCACATCCTCTGAA
TGTCATGTCCGCCCCTTGGGCCTTTCTCCATGTGGGGAATAGATGTCATC
GGGGCCATTGAGCCCAAGGCCTCGAATGGTCATCGCTTCATCCTCGTAGC
GATAGATTATTTCACCAAGTGGGTCGAGGCGGCTTCATATACCAATGTCA
CGAGGAATGTGGTGGTCAGGTTCATTAAGAAAGAGATCATCTGCCGATAT
GGTTTGCCAAGGAAGATTATCACGGACAATGGCACCAACCTGAATAATAA
GATGATGGCAGAAATGTGCGAGGAGTTTAAAATCCAGCATCACAATTCCA
CGCCCTACCGGCCAAAGATGAATGGAGCCGTGGAAGCAGCCAATAAGAAT
ATCAAAAAGATTATCCAAAAGATGACCGTGTCATACAAGGATTGGCACGA
GATGCTCCCATTCGCGTTACACGGTTACCGGACTTCAGTGCGAACGTCAA
CTGGGGCAACGCCATTCTCATTGGTATATGGATGGAGGCGGTGTTACCG
TTTGAGGTAGAAGTCCCGTCATTAAGGATTTTGGCAGAATCCGGGTTAAA
GGAATCAGAGTGGGCTCAAACACGCTACGATCAGCTCAACCTCATTGAGG
GTAAGCGCTTAACGGCCATGAGTCATGGGCGCTTATACCAGCAAAGAATG
AAGAGTGCATTCGACAAGAAAGTACGCTTACGCAAGTTCCATGAGGGAGA
CCTTGTGCTAAAGAAAATGTCCCATGCTGTCAAGGACCATCGAGGGAAAT
GGGCCCCGAACTACGAAGGGCCTTTTGTCGTGAAGAGGGCTTTTTCCGGA
GGAGCTCTGGTGCTTACCAACATGGATGGCGAAGAGCTACCTTCACCCGT
GAACTCTGATGTCGTCAAACAATATTATGCTTAGAAGCTGGGGCAATTAA
GGATGTCGCTGCATGTTCTGTATCTTTATGCGTTTTCTGGATTTCCCCCA
GGGATTTCCTGTCTGTTGTATCTCTCGTTACAATCTTTCAAAGAAATGAA
CGTGGATTCGAGGCTTTTAGTCCTCACGTTAGTTTCACATCTTGCGTTAA
TTTGTGATCACCTGAGCCCTTCCGCTCAGTTCATGGGATCCCCCAAGCGC
TTAATTAGAATTGAACCTGAACCAACTTTCCCTAAATTTTCTGCGTTTGA
AAACATTCATGCATACGCATACGCATACGCATGTATATTGTTGTGGTAAA
ACAGGGGCAGGATCACCTTGGGCTACTTTCTGGAGTGAGGACAAAACAGG
AATGGCAGAAACCAGTCAAGGTAGGGTAATGATGCGGCCAAAATTGGCCA
TACCTGGTTGTTTATTACTTGCAGGTACTTAAGGATGAACGCAAGCGGGG
ATGGGGTCACGACCGACCGATCGTTGCCCTTCTCTGTGCGAAACAAGCAG
GGAATGTCGCTGCAAGGCAGCCCCGTATCCTTTCTATTTTGTAGCTTTCT
TTTACTATTTGTTTGTTTTAAAAAAAGGAAAAGAGTAATAATAAGATAAG
TAATCAACGCCTGATTCTAACCTAAGTAAGTTCAAGTTAGGCAAAAGGCT
AATCCATGAGAAGGGAGGGGACATGGTCAATGTTCCCCTCAAAAAAAAAA
AAAAAAAAAAAAAAAGTGCAGGTTAGCTCGCCTGGGCGAAGCTGGGCTTC
GCCTGGGGCGAGCCCACCTCTGCACCAAAATATAAAAATGACGAAGGGGG
GGATGTTTTTTTTCATTCAAAAACTTCCCCCCCTCATTCAAAAAAAGAAA
GCTCACGGGACTCACGGATTTTGCAGCCCTTAGGTCACCATTTTTTGCGT
TTTTGATTCCGTTTTGCTCTATTATTCGTCTCCAACAAGTAAGTACCTCA

FIGURE 26Z

TTCTTGGGCTTTCTAGCTTTCCATTGATGTATTTTGGTGCTCTAAATTGC
ATGTGTTTGCTAAGAAACGTGAGGGATTTATCCTCAAATTGTTGCTTGTT
TTTGTTGAATTGAGGGGTTGTAAGGGATGGCCTTGGCCTAGGGTGTATTC
TGAAGTAATGGCGCATGCCACATTGTCCCCATTCTCTTGATATTCGTGCC
TAAACATGCGCCCACCAAGTGCTCGGTGAAATGCCTCAACGACATATGAG
CATGGTTTTGTGAGCTTTGGGTTGTGGGACTGTTTTATATGTATAGGGAC
AGCATGAAGGATTTAAAATGAATGCCCGAATGCAATTCTAGGCCTAGGAA
CCCAAGCTTTTAATTTCAATACAAGGAAGCATGACTTACGCCTAGGAATC
TAAGTTTTGGTTTTGAATGTAAAAAGGCATGAATATTAGGACATGTTTGA
GAGGTTGTTATTAGAATTTAAATTTGGCTGCCCCATGAGGAATACCTTGC
ACCTAGGTAGCATGGAAAATACCTTTCAACGGTATGTATATATGTGAATA
TATATAGCATGGAAATGCCTTGCAAAATATGAATATATATAGTATGAAAA
TGCCTTGCATAATATGAATATATATAGTATGAAAATGCCTTGCATAATAT
GAATATATATAGCATGAAGTGCCTTGCAAAGTGTTGGATGGGTAGCGTAA
AAGTGTTTTTCAAAATATATGTATTTGTGAGTAGGTAATAAAAGAAACCT
TCCAAAAAATGTATATATATATAGGATGTAGCATGAAAAGGTTTGTCAAA
AAATATGTACATGGATAGGTGTCGCAAAATGCTTCACACAAAATTTTTTA
TGTGTGCAAATACGTATGTGTCATAAAATAGCACGACCCCAATATGATTA
TTTTATAAAGTGCATGTTGACACTCGGGCCATGAGAAGTGTTGTTTGGCC
CTTGTTTGTAATGATTGTTATATTTCTTGTAAACTAACTTTCCAAATGTT
TGCCTTCGCAGGAATGGCCCCGAGGAAGCTTGCCTCAAAGAGGTCCAGGA
AGGACAAGGCGGCCGAAGGAACTAGTTCCGCCCCGGAGTACGACAGTCAC
CGCTTTAGGAGCGTTGTACACCAGCAGCGCTTTGAAGCCATCAAGGGATG
GTCGTTTCTCCGGGAGCGACGCGTCCAGCTCAGGGACGACGAGTATACTG
ATTTTCAGGAGGAAATAGGGCGCCGGCGGTGGGCACCACTGGTTACTCCT
ATGGCCAAGTTTGATCCAGAAATAGTCCTTGAATTTTATGCCAATGCTTG
GCCAACAGAGGAGGGCGTGCGTGACATGAGGTCCTGGGTTAGGGGTCAAT
GGATCCCGTTCGATGCCGACGCTATCAGCCAGCTCCTGGGATATCCGATG
GTGTTGGAAGAGGGCCAGGAATGCGAGTATGGCCAGAGGAGGAACCGGTC
TGATGGGTTCGATGAGGAGGCCATCGCCCAGCTGCTATGTATACCGGGGC
AGGATTTTGCCCGGACCGCTGCAGGGAGGCGAGTGCGAGTCATGCGCACC
AACATGACCACCCTGACCCAGATATGGATGACGTTGCTCCTCAGCAACAT
CCTGCCCACCGATCATAATTCCGACCTCCCCATGCCTAAGTGCCAGCTGG
TGTACGCCATCCTGACACGGATGAGCATCCATGTGGCTCAGTTGATCGCT
GATGCCATCTATATTTTTGCAGGTATGGCGCCCACTAGGCACCCTTTGGA
CCCAGATAAGTCCAACAGGGCTCTGGGATTCCCCGCACTGATCACAGGAC
TCTGCCAGTCGTTCGGAGTCCCCGTTGCACCTACCAAGGTGATTCGGCCG
CCCATCACCCGGGCTTTTATTGAGAAGTACTGTACCCAGAGACAGGCTCA
GGGTGATGCTCCACAGGCCGCAGGCGTGCCACCACCACCTCATCAGGCTG
GCCAGGCTGGGGCATTTGACATAGAGCAGTATTTACGGCATTTGGTTCGC
CAGCAGGCGGCCAACCACCGAGCACATGTACGGACCCATGATTGTCTGTA
CCAGATGAGCCTTAGCATGCAGAGCCAGGGCTTCGCTCCTTTTTCATGCC
CTACTCCAGACCAGTTCAGGGCAGAAGTTGCATGGCCCGGAGATTGGCCC
GAGGCCCAAGCAGGAGAGGCACCCCCAGAAGCTCCCGGCGATGGAGAAGA
AGCCCACGAGGATGAGGAAATGGCTGATTTGCTTGACTTCTTGGGAGGGA
GTGGAGACACGTGACTGGGAGATCCCCAGATTCATGTTTTCTTTCATATT
TCTTTTGTCATTTTTTTGTTCTATGTTATTGTTTTGACTTGAGAGACTAA
CGTTTGTTTTTGTTGTTTCGATTGTCATTTTGTACAGTGCATACATTTTT
GTTTAGATTGGTGCGTTAGTATTTATATATCATTACTATCGATGATGTTT
GAAATTCTGGAACCGTGTAGAGTTCTTCGTTTAGGAACATCGTCCAAAGT
ATATATGTAAAATAAACAAAAAAATCATGATAAAAGTAAAAAATAGAGAA
GGAAAGAAAATGAAATAGAAAAGGAAAGAAAATGAAATAGAAAAGAAAAG
AAAGTGATAAGGAAAAAGAGAAGGCAAGAGAAAATAAGTTGTCTAGCTAA
AAAACCAACATGCTTTTGAAAAGAGACGATTTCCAACTTTTCTTTGAAAA
AAGTTCATTGATCATAACCAATTCTTGGAAAATGTGTCTACACCTGAAGG
GTGAATGCTGTGAAATTTCCCCGGATGCCCGAAATGGACTCGGATGAATG
CACAAATTGATAAAAGAACATATTTTGGAAACATTGGGTCGATTAAAATA
GAGGGAATGAATCCTGAGCCCTAGCATCACATGACCATAAAAGTTTGACA
CTTGAGTGTCCGCGTAGATGCATGCATGACCAGTTTTGCATAAAGTTTCC
AAATCATCATTTTCGCATTTGTGTCATGGAAATAATGTGGGGCATCCCTT
TTATCCTTGAACCAAACCAAACCCTGACATGTATCATGTCTAGCCATTCT
ACAAACCTTGATTCAAAATCATGACTCACTATAATCCTTACCCTCGGAAG
CAAAAAAAGGAAAGAAGGAAATTTTCCAATCAAAGAGAAAGCAAAAAGAA
AAGAAAGGAAATTCCCAATCAAAGAGCGGGAGAAAGCAAAAAGAAAAGAA
AGGAAATTCCCAATCAAAGAGTGGGGAAAGCAAAAAGAAAAGAAAGAAA
ATTCCCAACCAAAGAATGGGAGAAAGTAAAAAGGAAGGAAAGAAAGTTCT
TGATCAAAGAAACTAGAAGAAATGTGCAGAAAGGTCTTTTGACCAGACAA
TATCTGAACAATACAGAATTGTCACCAAATGAACAAAAAAGAAGGAAAGG
AAACCACGACCTAAAATGGTCTTCTCCCTTTGTTTACCAACCAAAATCCC
GTGCGCTAGCGACCTTTTTTCTCGCCCCGCACTAAACAAAAAAAAACAGA

FIGURE 26AA

CAGAAAAAGGAAAAGCTAGAAAAATCAAAAGCCAAAAACACACAAAAGCC
GAAAGAAGAAACCACCAAAAGAACCCATTCCCAAGGGAAGCCCTATTGAT
CCATGATCACGCGTGTAATTTTTGATTTGATAGGAAATAATTTGTAAAGT
CAAGTCATGACATATCTATGGTTCGGAATTAGGATGAAACACTTACCTGT
GCGAGATTGATACACTTTGAGTAGATTTCTTCTATTTTTGTCGAACCCAG
TGTTTCCTCTAAATGGTCATTTAGAAACGAAATGCTAACATCCAAGATCT
CATTTATGGTTATGGGGGATCCCATCAGCAGACTCTCCTTCCCTGGTAG
GCGCATTGTTTGTCACTCAAAAAAAAAGCATATGCTGCTCTAAATCAGTT
GGAATATTTGTCTCTTTGCTAAAGCATGTTTGCATTTTAGTGGAGAAAAC
AACGAAACTTTTTCAAGCCTCACAAGTTATCCAGAACTACGTAGGTCTGA
GTTCCTCATTGGAGGATACGTAGGAGCAAGAGCCTCGCTTTTGTCGACCA
CACCGCCTTTTGTTGCCATAACTCAAGAGCTGGTAGTACGCGGAGATACC
TTACGCTTATCCGCACCCCTTTTGCCATTCAGACACAGTCGTGTCCGTTG
GCAAGCAGAGACCAAGTTTGGTCATTCTGCACACATGATACGCGGAGATA
CCTTACGGTTATCCGCCCCCCTTTGCCATTCAGACACAGTCGTGTCCGTT
GGCAAGCAGAGACCAAGTTTGGTCATTCTGCACACATGATACGCGGAGAT
ACCTTACGGTTATCCGCACCCCTTTTGCCATTCAGACACAGTCGTGTCCG
TTGGCAAGCAGAGACCAAGTTTGGTCATTCTGCACACATGATACGCGGAG
ATACCTTACGGTTATCCGCCCCCCTTTGCCATTCAGACACAGTCGTGTCC
GTTGGCAAGCAGAGACCAAGTTTGGTCATTCTGCACACATGATACGCGGA
GATACCTTACGGTTATCCGCCCCCCCTTTGCCATTCAGACACAGTCGTGT
CCGTTGGCAAGCAGAGACCAAGTTTGGTCATTCTGCACACATGATACGCG
GAGATACCTTACGGTTATCCGCCCCCCCTTTGCCATTCAGACACAGTCGT
GTTCGATGGCAAGCAGAGACCAAGTTTGGTCATTCTGCACACATGATACG
CGGAGATACCTTACGGTTATCCCCCCCCCCTTTGCCATTCAGACACAGTC
GTGTTCGATGGCAAGCAGAGACCAAGTTTGGTCATTCTGCACCCATGATA
CGCGGAGATACCTTATGGTTATTCGCACCCATTCTTTTGCTATCTGTAAG
ACAGAACGCTTGATAGCATGCAGGGGCTGACACAGTCTTCTGCACCTTTT
GTTCCTCTGGGAACAACAAGTCATTTGCATGTGGAGATTTTATGGTCACC
CGCGACTCTCGTCGAAACGAGAAGGACGAAATTAGTGTCTTATCTTTACT
TTTCTTTTATCTCCAATAAAAGACAAGTAAAGAGGGGCAACTGTCATACC
CTAATTTCGTCCGGGAACCTTTGCTCGATGACATGCGACCATTCTTTGGT
CCTTGTGAGGTGCTTGGCACCCATCATTAGGCAATTTATGAAATTCCAGG
ACATGCCGAAAAACCAAAAAAAATATTGATGCACAATCCGTAAGTTTCCG
TGACACACCGGAAATCAAAAGGAAGCATCGTTGCATAATTAAGTGAGGTT
CCGTAACATTCCGTAAGTCAAAAAGGGGATGATTATGTAATTCGCAAGGT
TCCGTAACATTACGGAAAGAAAATAAGTATCGTTACGAAATTCGTAAGTT
TCCGTAACTTTACGAAAAAAGAATCACCAAAAAAACAGCAGAGGGGGTGT
ATTTAGTAAAAATGGGGGTGCAAATAGCACCCAGGCCCACTTGGGCCCTC
CAGAAGATTCCTCCAGAAGGCGGTTGCTTCTGGAGGAAGCAACCCTGCTC
GCCTGGGCGAGCTGAGCTCGCCTGGGCGAGCTGGGCGGCAAGCATCTCCC
CCTATTTTGCTATAAATAGGGGAGAAAATGAAGAAGAAAAGGATCCCAGC
CCTTTAGGCACTTCTCTCTCTTTGGAATTTGCTTGGAAAAATTGTTTCCG
TGAAGAAAATCTAAGCCGAGGCGCTTCCGAAACGTTTCCGTAACGTTTTC
CGTGAGGAATCTCGCAAAGGTTTGAACCGTTCTTCGACGTTCTTCATTCG
TTCTTCATCGTTCTTTGATCTTCAACGGGTAAGTACCTCGAACCAAGCTT
TTCGATTCATTCTATGCACCCGTAGTGGTCCACATTGTGTTTCGTGCATT
TTGATTCTCATTTTGTTTACTCTTTATACCCCCTGTTGACGTGCTTAAGC
CATTTTACTTAAGTCGTTTCTCGCTTAACTTAAAAATAAAATAAATTTCC
ACCGAACGTTTGAATTGTATTATCCATTAGCTTCGGTTAAAATAAATTCC
GACCGTTCGGTCATGCCGTAACCACGTTGGAAATCAAAAAGAGGTAAAAA
ATAATATAATAATCAAAAAGACATCTTTTAGTAAAATAAAGCGGAAAATC
AATCGGACGTTTTCTCTTTGGGATTTCTCATTCTTAACCGAATTGATTAA
TAACTAAAGTGAAACTAAGGCTAACATCAACTCGCCTAGTCAAGCTCGTC
CACAAAAATAAGCTTTTGAAGTTTGTCATTTCAATTTCTCACTAAGTAAA
ATGGATCATTTTTAAGGTCCAACGCCTTAAAATGATCACCACTTAAGTAA
AAAAGAATCACTTGATAAGAAAGAACTACGTAGGTCTGATTTTCTCATCC
CAAATTGAGGAATACGTAGGAGCAAAGGGAAACACCCTTGTCGACCACAA
AAAAGGAAAAAATATAAAAAGGGTATAAAGGATATAAGAACATAAAAGGG
AATAAAAAAATCAAAGTCATGTTTGCACATTCGATTAAAGGCTGCCGTCC
CTTGGGACGGGCGTGTGGGGTGCTAATACCTTCCCCGTGCGTAAATACAA
CTCCCGAACCTTTCAAACTTAAAAATTCGTAGATCGCGTCTTTTCCGGTT
TTTCCGACGTTTTCCTCAAATAAACGTTGGTGGCGACTCCGCACGTATTC
CTTTCGTGGAACACGCATCCCGCGAGTCACGCGTCGCCCTCCCGCCGAAG
GGGTAGGTTGCGACATCAAGGAAATGGATGTGCTTATGATTCAAGCAAAG
ATTGAAGAAGATGAGGAGGTAACTATGGCTCGATTTCTTAATGGTTTGAC
TAATGATATTCGTGATATTGTTAAGCTGTAGGAGTTTGTTGAAATGGATG
ATTTGCTTCACAAAGCAATCCAAGTAGAGCAACAATTAAAAAGGAAAGGA
GTGGCTAAGAGGAGTTTTACCAACTTTGGTTCTTCTAGTTGGAAAGACAA
AGGTAAGAAAGATGGGGCTGCTACTTCTAGTAGTTCCACACCTACCCCAT

FIGURE 26BB

CAAAAACTCGCTCAAAGTCCCAAGAGGAACCCTCTAAAAGAAGTAGAGAT
GTGAAGTGTTTCAAGTGCCAAGGCCTAGGACACTATGCTTATGAGTGCCC
TAGCAAAAGGTCCATGGTTCTTAGAGATGGAGAATATATAAGTGAATCCG
ATGTTGAAGAGGAAGAAGAGAGTGAGTACGTAGAGGAAGAGGAGACTCCG
GAGGGAGATTTGTTGATGATTAGACGGTTACTTGGTGGTCAATTGAAGCA
TAAGGAGGAGAGCCAAAGAGAAAACATATTTCAAACTAGATGTTTAATCA
ATGGCAAGGTGTGCATGGTGATCATTGATGGAGGTAGTTGCACCAATGTG
GCTAGTACTAGATTAGTGTCAAAGCTAAATTTAGCTACTAAACCACATCC
TAGGCCATACAAACTTCAATGGCTTAGTAAGGATGGGGAGGTACAAGTAA
GGCAGCAAGTTGAAGTGGATGTTTCCATTGAGAAATACAATGATAAGGTA
CTTTATGATGTTGTTCCTATGGAGGCCAGTCACTTACTTTTGGGGAGACC
ATGACAATTTGATAAAAGAGCCAATCATGACGGTTACATCAAAAAGATCT
CTTTCATGCACCAAGACAAAAATATTGTGCTCAAACCATTGAGTCCACAA
GAAGTGTGTGAGGATCAAAAGAAAATGAGAGAAAAACTTCTTCAAGAGAA
AAGAGAAAAAGAAAAAGTGAGCAAAACACTTGAGAGTGAGAAAAAGAGGG
AAACACTTGAGAGGAAAAAGAGTGAACAAAAGAAGAGTGAAACACTTGAA
GTGAGGGAGAGCTATTTAGCCACAAAAAGTGAGGTCAAGAGGTTGTTTCG
TGCTAAATAGTCACTATACATCTTGTTTTGCAAAAATCAGATTTTAACCA
ATAACACTTTTGATGATTTTGAAGTGCCTTCTAGTGTTAAAACTCTTTTG
CAGGATTTTCAAGACATGTTTCCATCAAATGTGACAAGTGGACTACCACC
TTTGAGGGGAATTGAGCATCAAATTGATCTCATTCCAGGAGCTTCTTTGT
CCAATAGGCCAGCCTATAGAAGTAATCCACAAGAAACCAAAGAGATTCAA
AGACAAGTGGATGAACTCATTAGCAAAGGTAGGGTAAGAGATAGTATGAG
TCTTTGTGTTGTCCCGGTGATTTTGGTCCCTAAAAAGGATGAGACATGGC
GCATGTGTTTCGATTGTAGAGCCCTTAATAACATCACCATTAAATATAGG
CATCCTATACCTAGGCTTGATGATTTGCTTGATGAATTGCATGGTGCATG
TTACTTTTCTAAAATCGATTTAAAAAGTGGATACAATCAAATTAGGATTA
AAGAAGGGGATGAATGGAAAACTGCTTTTAAAACAAAATATGGTTTGTAT
GAATGGTTGGTTATGCCCTTTAGGCCTAACTAACGCTCCTAGCACTTTTA
TGAGATTAATGAACCATATCTTGAGAGAGTTCATAGGAAAGTTCGTTGTG
GTGTACTTTGATGATATTCTTATCTATAGCACTTCACTTGATTTGCATAT
TATTCATTTAAAATTTGTCTTGTGTGTGCTTAGAGAAGAACAATTGTATG
CCAATCTTGAAAAATGCATCTTTTGTACTAACCATGTTGTGTTTTTTGGA
TTGGTTGTAAGTTCAAAAGGAGTGCAAGTTGATGAGGAGAAGGTTACGGC
TATTCAAGAATGGCCTACACCTAAGTCCGTGACCGAGGTGAGGAGTTTTC
ATGGCTTAATAAGTTTTTATAGACGATTTGTGAAGGATTTTAGCATATTG
GCAGCATCTCTCAATGAAGTGCTCAAGAAAAATGTTGGTTTCAAATGGGG
AGAGAAACAAGAAGAAGCTTTCAATGTTCTTAAGTAAAAGCTAACTAATG
CCCCCATACTTGCATTGCCAAACTTTCAAAAATCTTTTGAAATTGAGTGT
GATGCTTCAAATGTTGGGATTGGGGCTGTGTTGTTGTAAGAAGGCCATCG
AATTGCTTATTTTAGTGAAAAGTTAAGTGGTCCTATCCTTAACTATTCAA
CTTATGATAAGGAGTTGTATGCCTTAGTACGGGCTTTGAAAACATGGCAA
CACTACCTTTATCCCAAGGAATTTGTCATTCATAGTGACCATGAGTCCCT
CAAATATATCAAGGGGCAAGGCAAGCTTAACAAAAGGCATGTGAAGTGGG
TGGAATTCCTAGAGCAATTCCCTTATGTTATCAAACATAAAAAGGGAAAA
GGTAATATTGTAGCCGATGCTCTTTCTCGGCGTCATGCATTACTTTCTAT
GCTTGAAACATAATTGATTGGTCTTGAATGTTTGAAAAGCATGTATGAAA
ATGATGAAACTTTTGGAGAAATTTTTAAAAATTGTGAAATTTTTCAGAAA
ATGGTTACTTTAGACATGAAGGCTTTCTTTTCAAAGAAAACAAATTGTGT
GTGCCTAAATGTTCTACAAGAAATTTGCTTGTTTGTGAAGCACATGAATG
AGGTTTAATGGGGCATTTTGGGGTCCAAAAGACTCTAGAAACATTACAAG
AACATTTTTATAGGCCTCATATGAAAAAGGATGTGCATAAATTTTGTGAA
CATTGCATTGTATGTAAAAAGGCAAAGTCTAAGGTAAAGCCTCATGGATT
GTATACTCCATTGCCAATTCCGGAGTATCCTTGGATTGATTTATCCATGG
ATTTTGTTTTGGGGCTGCCAAAAACAAGCAGTGGTAGAGATTCCATTTTT
GTGGTTGTTGATAGGTTTTCTAAAATGGGTCATTTTATTCCATGTAAAAA
AGTTGATGATGCTTCCCATGTGGCTGATTTGTTTTTCAAGGAGATTTTGA
GACTCCATGGTTTGCCAAGGAGCATTGTTAGTGATAGGGACTCTAAGTTC
CTAAGCCATTTTTGGAGGACTTTGTGGGGCAAGTTGGACACTAAATTGTT
ATTTTCAACCACTTGTCACCCACAAACCGATGGGCAAACGGAAGTTGTTA
ATAGGACATTGGGAACTTTGCTTAGGACAGTTTTGAGGAAGAACTTAAAA
ACTTAGGAAGCTTGTTTACCCCATGTTGAGTTCGCTTACAATGGAGTTGT
TCATAGCACCACTAATTGTTCTCTTTTTGAAGTTGTTTATGGTTTTAACC
CACTAACTCCTCTTGATCTTTTGCCTATGCATAATGTTTCTGTTTTTAAG
CATAAAGAAGGTCAAGCCAAAGGCGGACTATGTGAAGAAGCTTCATGAGA
GAGTCAAAAATCAAATTGAGAGGAGAAATAAAAGCTATGCTAAACAAGCA
AACAAAGGGAGAAAGAAGGTTGTCTTCGAACCCAGAGATTGGGTTTGGGT
GCACATGAGAAAAGAAAGGTTTTCGGAACAAAGGAAATCAAAGCTTCAAC
CAAGGGGAGATGGACCATTTCAAGTGCTTGCAAGGATTAAAGAATCAATG
ACAATGCTTACAAAGTTGAGCTGCCCGGTGAGTATAATTTAGTTTCCAC

FIGURE 26CC

CTTCAATGTCTCTGACTTATCTCTTTTTGATGCAGATGGAGAATCCGATT
TGAGGACAAATCCTTCTAAAGAGGGAGAGAATGATGAGGGCATGACCAAG
AGCGAGGGCAAGGATCCACTTGAAGGACTTGGATGACCTATGACAAGGGC
TAGAGCAAGGAAAGCCAAGGAAGCTCTTCAACAAGTGTTGTCCATACTAT
TTGAATACAAGCCCAAGTTTCAAGGAGAAAAGTCCAAGGTTGTGAGTTGT
ATCATAGCCCAAATGGAGGAGGACTAAATGGCACCACTTTGTCTCAATTT
TAGAGTGTTTAGTTTGTCTAAATAATGGCTCAATCCTTGTAAAGTTGGCT
GACCATAAATATGTTTTGGGTTAATCAACTAAAAGGACTTTAGTTTGGTT
TAGTTCAAGTTGTAATAAGGGCCCAATTGGCAACCTAGGCATCAGCCTTT
TAGGAGACCAAATGGTGGCTGGCTTGATGGCTGTTAGGGGTGACTTTTGG
TTGCCACAATTTTAGTTACATTTAGCCATTAAGTTCTTTTAATTCCATAG
GTTAGTGGCATTAAGTTCTTCAATTATAGGTTAGTGGATCATTACTAAAA
TCTGATGTAAAGCTTCTATATAAGCTGAACCATTTTATCAATAAACACAA
GTTTAGTTTTATTCAGAAAATTAAAGTTTATCTCTTTTATCTTAGTGAGA
GTGATTCTCCTAAGTTCTTGAGTGATTCAAGAACACCCTGGCTATATCAA
AGGACTTTCACAATCTTTGTGTGTTGCCCTCGCCGGAAAGAGTGATTCTT
TCCTTCCTTTCATCTTCAACCTTGTTCTTTCAAACCACAATTCCAGAAAA
TCCACTTCTGCCCATAATTATCTCGTGGCCATAACTCCTGTTTTACGCGC
TCAAATTAAGTGATTCTTGAGCCTAAATTGAATTTCAAAACGAGATCTTT
CACCTCGTTTTGGAATCACCTCATTTGGAGCCCTGTATCTTGAGTTATTG
CCATTTCTATATTTCTGTCCAACCACCACTTAACCTACGTTTTATCATCT
CATTCTTCCATTTTATGCCAAGAATCACCTTATTAAGGCCAATGAAATTA
GCCACTGCTCAACCCTTAAATCTTGCCAATTTTCCATCCTTTCCTTAATC
AATTTCCGCATTTTCCATCAAGGTTTAATCCTAGACGATCCTAAGTCTTC
CTCTGTGCAATGAAGGTTCATATCAATGAAATAGCCTCTCAATGCATAAA
ACAAAAAGGTAAGGAGAGATGGGATCTCCCTGTCTAACCCCTTTTTCTAG
TCTAAACTCCTCTAGAGGTTCACTATTCCAAAACATACGTATCTTGGATG
AAGAGATGAAATGCCAAATAATGTTCACAAAGTTCTTTGGGTACCCAATA
TCCTGTAAAGCATCTCGAATAAATGCCCAATTCAAGCAATCATAAGCTTT
CTCCAGATCAATTTTTATTGACATCCATCCATTTGTAGTTTTTTGTGTCT
CATTGAATGAAAAACCTCTTGGGAAATAATTACATTATCTCTACTCTGAT
GGATGGGAATAAAGTTGACTTGACAAGGGCCAAGTAATTTCTCCATCAAG
GGCCTTATACAATGAGAAAGAACTTTAGTGATAGCTTTGTGGAAAACATT
ACATAAGCTAATCAGTCTGAAATCCTTCAATCTAGTCATATGTTTCACCT
TGGGGATAAGAGTGATATGTGTATCATTAATCTGATGCACCAATTACAGA
TCCTGAAACACGCTTTGAACCAACTTGACAAGAGCATCCCCCGCTGTATT
CCATTGACTTTAATAAAAAAAACTGCATGGAAGCCATCAGGGCTAGGAGC
CTTAAATGCTCCCATATTCCTAATAATGTTAAGAACTTTTTGTGAAGACA
CATCAACTCCAAGGGAAAAAACAAATTCCTCATCAATTAGAGGAAACATA
CTTGTTACAGGGAACTCATCAACACACTGATCATCAACAAATAGGTTCTG
GTAATATTGAGTCACCATACTTTTCAAAGATTCCCCATCCGAAACCCAGG
TACCATCTTCTCCCTGAAGAGTCTCAACTCTACTCCTTCTCCTCATAATA
ATAGTAGTTCCATGGAAGTAACTTGAGTTATGATCCCCCAATGAGAGCCA
TTTGGAATAAGCTTTCTAGAACCACAAAATCTCTTCCTGTAGCATCACAA
CCTCATATTCCCTCCACACAGAATACAACATATATGCCTGGGTGGACTTA
TCCCTCTCACCCATCCACTTGTTAATTCTATCCATCCGCCTGAGAAGGCT
TCATTTCTTAGAGAAAAAAAATTCCTAAACACATTTTTATTCCAATCTTG
CACATCTTTTTGAAACAAACATAACATATCAAACCAAGACAAAAAAGAGT
TCCAATGGGAATGCACAAACCTCTTGAAATCATCATGAGTAATCCATGCA
GCCTAAAAGGTCTTGTTTGAGAGTGATGATTCCTTTCCACCTCTAATCTA
ACCAAAAGGGGTCTATGATCCAATTTAAAAGGGGGAAGATGCAGCATCAC
AGCCTCTTGGAATTTTATTCTCCACTGCAAGTTAATCAAGAGCCTATCCA
ACCTCTGTTCAAGGTTGCCTCTTTTCCAAGTATATGGTTACCTTTGAAAC
CCATCATATATTAATTCACAGTTTGAAATCATCTATTGAAAGCTTGTAAG
ATCACAAAGAGATGGATTGTCAGCACCTCCAACCCTTTCATGTGGATGAA
GAATGGAATTGAAATCACCAATGATAGGCTATGACTTATCAATCTCACAA
GCTAACTCTCTCAACACATCCCACATACCCTGCCTGCACTAGTAATGAGA
ACTATTATAAACCACCATTAATAACCAATCATTAGAACTCTTCCAACTAA
CCTTCAGATGCACATGGTATCTAGAATTTCCCAGCATCTGAACCTTCCAT
AAGCTTGAATCCCACAAGCAGCAAATACCACTAGAGTGGCCCACAACTTC
TTCCACAACCCAATCCTTGGATAATTTTCGTGGCCCTTGCACCACTAGAG
TGGGTCTCCATAAAAAATATTAAAGAGGATGGATATTCCCTTTTGATATC
TTTAATTAAAGAAGCAAAAACTCTATTGGACATACTGTGACAATTGCAAG
ACAAAAAATTCATGGAGGCATAGCAACATGGATGGCCTTAACATGGCCTT
GGCTACCCTCTTGGCAAACTACCATATCATCATTCTCATTTTTGAAACTA
GCATTACTACGACCACCTTTAATTTGTGCCTCACCAACAATGCTTGGGTC
AGTTGGCACAACTTCCTTTTGCCTCTAACGCTAAAGACTGCTTTCTATAG
AGCCTTAATCATTTTAAGCTCTTAGTCCCTATCAATAATCCTTCCCTGTG
GTGGTTAAGAAGGTTCTTGACTCACTAAGCTTAAAACCTGTTTTCCCTTC
TTAGAGGCCTTCCCTTTATTGGCAATTCCCATTTTAGTATTTCCCTTTAT

FIGURE 26DD

TTGCTTTTCTTTCGGCTTCCTTAAAACTGGGCCTGTGTTTTTAGTTGGCC
CAGTTTTACCCTCTTCTACCACATAGTTCGTCTTCATCTCCTTAAAAACA
ACTCCCCTATTCTGTTTCTGAACACCCCTTTGGGCCACTAGTGCTAGGCCC
ATTAGCATTACGCTTAACTCTAGAGACCAACCTTTCCTCACGTGCTTCAT
TAAGAGCAATGAATTTTGACCCAAATGATTTGTTGTTGCGATCCTCACAT
CCCTGTGCTACAATCTTGGTATGATTGGCAAGGCCAACCCCATTAAAGAG
AACTTTTAACTAATTCTTCCTCACACTCCTACGCACTAATTACCAAGGCC
CGAAATGATTGGCATTATCATTACTCAAAACATTCACTTGATTTTCGTTT
TCAAATCTGGACCATTAATATTATTCATTACGCCATTATCATGCACACGC
CACCCTGTCAACTATCTCCACCTTAGCCACCATATATCTCCACCAGTTTT
TTCGTCCCTCGGCTTTTGTTGGGATTGGATATCCACAACATCGGCTTTCA
TCTCCACAGAGTTTGCATCCTTGTACCCATACCTCCCACAATTAAAATAG
ATCAAATGCAATCCTTCATATTGTAGATTTAATAAGTAACCTCTAGCAAT
AATCTTAGGCTGCAAAGGTTTGAATAGATCAATCTCAACACAGATTCTTG
TGAAACAACCCCTTGCTTGGATAGTCATCACTCTGTCGATTTTAAGCATT
ACTCCAGGAGTAGACCCTAATCTCCATAAGAATTGGTCGTTGAACAATTC
AATAGGAAATTTTGGGAACCTTATCCACAACCATCCTCCTTTCGACATGC
AGATTACCCAAGAGGAAAGGACGCCATCTTTACACCAGAATATAATGATC
AACCACCATCCATGCCGCCCCCCCCCCCCCCCCCATGAAAGCATGGTTGTA
ATCCTCACCTCATCAGATGTGAACAAAATCTAATAGTAGTTTCTTGGCAC
ATCAATGATCAATGATCTTGATAGCACCATTCTTTGCCCACTCACAATTA
AACTTGGCCTCCTATTGCTGAAAACCCAATCTCTTCCCCATCACCATGAC
CATCAAGGACCCCCTTCCATGGCTTACACCAGTCACTAAACTCCTTATCG
GAAATAGGAACTTCTGGGAAACGTTCAAAGTCCTCCTTAGATATTGGCGT
AGGAGGTATTTTCTGATCTAGATACCCAAAACATCTCCCATCAAAAGTTG
AAAAAGCCATTGGACCACCATTCTTCAAAAGCTTCTCTCTATACGTACCA
TCTGGCACACCTTGCTCGGCCTCCTTATCTTTATCAAGCTCCATCTCCGA
ATTACCATCACCTTCCTCATTAGGCTTCCTATTGACTTTCCTAGTACTAC
GCTGGATATCATCTTCCTCCTTAGAGGATTCAGAAGAAACCCTAGTAGAA
CTCTCAACACCCTCGATTACAAATTATTTATCCCTAGTGGGTTCCTGATG
GACATTAACATAGCTATTCATTTATAAGTTACACTTACATATATTTGCAA
GGCATCCATGAATATCTATGGATATTTCCTAAAACTTAAAATATAAAAAT
AAAAATAAGCAACTAAATTATTTTATGAGCTCTGCACAAATAGGCGCTGC
AAATATCACTATAAAATGATAAATTAAAGAGTTGGGGAAAATAATCACTT
TCACAATTTTTTTAATTATTCTTCTATTTTTTTTCCTAAAAAATAGTTTA
AAAACCCACAAATTTACATTCCTTTTCTCCCATATAAGATAAATGTATAA
GATTTGTCATATTTCTGGAAAAAAAATGAAATTATTCAAATTATCTAAAAA
TTTCTCTCTTTAAAGTATAAATTCAAATAAAACTACACGTCGAAACATCA
ATTATTTATAAGTATATCCATATTAATTATTTATAAGTAAATGCACTTTA
GTGGTAGCTGGTATCTATGAGTATATGGATAGTATAAAATCCGTTCCCGT
TCCATTTACAAATAGGTTAAGAAAAAAACCTATTTCAATTAATTATAAAT
ACTCATTTAAATATTCATTTTTCCGTGACAAATTTTACCTGTGAGTATTC
ACGGGTACAAGTTTTGAAGTCCTTGCATTGGTTTGCATCTTTTACACGTT
TTTTTCTTTCACAAAAAAGGTATTTTTTTAATACACATCTTTTACAAGTA
TTTAAGGATTCGTATCAGTTTTTGTCATAGTAGTAACTATTTAGTATCTT
TTTTCATTTAAGCTGTCCTCTGCTTATTCATGATAATGACGGCTAACTGT
TAAGTTTCTTCTTGTATCTGTTTTTATTTTATTTTTTCTGACTTTGCCCA
ACGGTTTATGATTGCCGAGCTGCTATTGGTTCCACTAAGCTTGACCCTGT
AGGAAATATTTTCCTTTTTGCTAATTTGGAATTATGACTATTGGTCCAAA
CATGGAGATAAGATCATTGCATTTATCCATTTTATTGAGATTAATTAAGT
CTAAACATAAGTTGAAATCTGCCCATGCAACCAACGTCCTTTCATTTTTA
AATAATGACATAATATGTGTCACCGTCGTTGCTCTCAAATTCAATTAACT
CAATTGAGTGAATAACCAAACAACTCGACTGGTAACAGTAACATCAGCTA
TGTTTCAATTTCAAAGCCTTCTATTCTTTCGAAATCGTATATATATTATG
TTCGCCTATTTTATCACGACAACCTTATGCAGAGGGTTTATTTTGTGATG
TACGGAAAAAAAAATTATTTATTCCATGACTTTAAAATAATTATTATTTT
AGATTATTTTATATAAATAAAAATTAATAAATAGATGAAATAAAATAATA
ATTTCATAAAATTCGGTATCTTAATATTAATAATTACTTTAAAAAATTAA
ATATGATATTTATTTTGAGATAAATTTATTTTCAAATATAATACTTATTT
TAAGAAAAAAATACCTATTAATTATTTCCCACACAGAAAGAAGCAGACAA
AAGTGTTCAAACGATGCATACATGTGGCTGGAAATAAAATATAAATAGGG
TTATTTAAACAACTCTTTTTCTATGCTTTTGATTATTGATTAGTTTCGCA
CCATTTCTGGCTTCAGATGATACTTGGGGTGTAGATATAAGGGGAAAATA
AATTGGGTTGATTAGGTCTAAATATGTATTATCAGGTTTCAAATTATAGT
TGGTTTCGTTCGGTTTTTTTGGGTACATGGCTTGTTTCAGTTTAAATCTG
AATATATTAAAAAGATTAAAATAAATTAATTAATTTGATTTAACATTTTG
ATTTCGTAGAACTAAACTAAATTAATGAACAACCTAACTTTCAATTAGGG
TATCTTTATGCAGGACGGAACGATAAAAAAAAAAATCGAGGAGGGGCAAA
AATTTAAAAGCAACCATAATTAACTTTTACTATCAATAATTATTTTAAAC
TTTCTTTGAAAGAATAATTATTTAAAACTTAGTCTATTGAAAAAACTAAA

FIGURE 26EE

ATATCATATATCCCATTGTTATATTTTAATTGTAAAATAAAATATAGTGA
AATAGAATGGTGTCTAAATAAGTTACTATTTCATTGTTTAAATATTTTTA
TGATGAAATGAAAAAAAAGAGTATTTCTATCTCATCATTCTTTAATTAAA
GGAAAACATATAAATGTAAAATAAAATAAATATATTTTATTTCATTCCAT
TTAAACAATACAGTTTATTTTTTATTATCGTCTTATTTTAATGTTATTTT
GAATAATTAAATAATAAAGTTTGATATCATTTTATTTTATTGCGCTTCAT
TCTATCTTTCTTTCTTTTTAATCAAATTAATCACAAGACTATGGACCAC
TTCCTTTTTCCTTAATTTTCAATTTTTGCATGCACTTTTACAGTATGAAA
GGCATAAGAGAGAGATTGGGGAGCTGCAGCTCCCTGTTGGACCATTCCAT
CAATCTTCAAATGTGGAAAAAGAGGTTTGTATAATGTTCTTTCTTCCCAT
TTTTATTTGTAGATTCCATGCTCACATGAAGATTACTTTTATTATATCTA
TTGTTTTCCTTTGTCATTTGAACTTGAATGAAGCTCCTTCTTTCTTTTTT
TTTTTTTTTTGTGCACACACCACTGCAAGAAAACAGAGGCACCCAGATAT
AACTATGTTGCTGCTACGACTGGAGTTTGAGTTCTTCATTTTTTTTTTAG
ATAATTTTTTTGTTTTTATCTCTAGTTACTGAAATTATCCGAGAGTCTTC
ATTATATACTGTTGGAGTTTGAGTCCTTCATTATTAAAATAAATTCTTGG
ATTGTAAGTGATGATAGGATAAATTGTAGCCACACCATTATTTTATTCTC
TTCTAAGCAACCACACGAGATGGGTTTCATTTCCGAATTTTGACCCTCCC
ATGTATTAATAAGTTACTCTTGACAAGTTGTTCGTATATAAATCTACTTT
GATTACTTAAACTAGGGAGTTGATAACATATAGATCTACTTTAATTACTT
AAGCTAGGGAGTAGACACTAGTTATTTTTTCTTTCTTTCCATCAATCGTC
AATGTTTTGGCTTAAGGCTACCAGAGATAAAAAAAAAAAAAATGACAGAAT
CGAAATAAATAAATAAAATTAAGCAACAACAAAAAAAAAAAGAGATAATA
CGATGGTTCTTAAATAACCGTCTTAGAATGTCTTACTTTCTAAGCCGGTT
ATTTAGGAACCATCTAAAATGTCGCATGTTGATCAAAACATACTAGGACG
GTTATTGAATAATCGTCTTAGAAAGTAAGACATTCTACGACGGTACCTAA
GAAATAGTCTTAGAATGTCTTACTTTCTAAGACGGTTATTCAGTAACCGT
CTTAGATCCGACGACATACTAAGACGGGTTGTTACTCTAAACCGCCTTCG
AAAATGGATCATTCTAAGACGGCTGTTTACTAACCGTCTTAGAAATCTAT
ATTTTCTAAGATGGTTGAAAAACCGTTGTTATAAATATGATGCTATTTTA
TGATGTTGTATTCTATGACAGTTCAAAACCGTCATAGAATGACAAATTTA
ACCGACTTAGAATATCATATTTGTAGTGGTGTTAGGCTAATATTTCGAAT
GATGCTACTTGTTTTCCATTGTCCAACATAAAAAAAAAAAACCCAAACGTT
AGTAATATAGGAAAGAAAAAATTAAGAATCAAGGATCAATAATAACACCA
CGAGTCAAGACATTTTCATGATTTTATTTGTGTATTTTTTTATGATTATC
CAACTGAAAATATTAAGCAATACTAAGAAATATCTGGCAAAGCTTCTTAG
TATATAATATGAATGACATTGAATTATAAGCAATTTAATAAGCCTTTGCC
TGAGCCTTTTTCATCTTCCAAGACTCGGTTGGATTCTGACTTGTAGAACA
TGGAAAGAAGAAGGGTTCTTGGAATCATTGGACTTTGAGAATGTGGAGAC
ATGAGAAGCATCAAAGGAGGATCAAGAAGAATAGATTGTCGATCTTTCCC
AACTTTTCATAGGTAACAAGTTAGCATCCGGTGGTCATAGTATTAAGCTC
TTACACTCTATAGTACTGGACTCAATTGTGAGCCTGTATACAAACACATT
AGATGGTTTGTTTGTTTAGCTTTATGGCTTTTTGTTTGTGTAGGAAAACA
CGAATTCAACTGTTTTGAGTTCAAAACTCTAATATGCCTTTCCTTGTTTT
ATTTTGCTTATGGTTTTTACTTTTTTCTTTTTATATACTCACTGCCACTT
TAGTGTTTTGATGAAGGATAGCATTTGGTTTGAGCTTGAATATACAATAT
AAATAATCAATAATTTTTTTTTTGTTGTTTATAATAATTTTATCATGTTCA
ATTAGAATTGTCTTCCCATGATATGGTCAGGGAGCAGAAGGTGAACTTCT
GAAATCTCAAATAATAAATAGCCTTACAAGACACCAACTTGAACTATTTT
TTTTTCTTTCCTTTTGATTTTTGTCGTGTATTTATACGGAGTACAACACA
TATAATACTATATATATTATATGCATATATGTGTGTGTGGTCATACTTGT
CAGTTGCATTTATTATCTTGAACTGCAGGTGTGTGTGTATTTCCATATAT
ATGAATACGAATGGGTCTTAATTTACACTTTATTGCAGCTTGTAAAAAGC
TGTGGGTGTACTGTATCATAACAAAATACATGTCACAAGGAACTCTGAGG
ATATATGTATCCGAACAAGAAAGAGTTGTACTCTCTTTCAATAGAAACTA
TACTAATGTTAGCTCTTGACATACTTAGGGGTTATGGAGTATACAAGAAC
AAAGCAACATGAGTTTTTAAGAATAAATCTCCATTGACTTAGTAATGCCA
CAACACTTAAAGAGTGTCTACCTAAATTTGATGTTCTTGTTTCTACAACT
TGTAAGATGTCATCTCATTACTTTCAAAACTGTCACTTATAAACCAATGT
CAAAAAAAATATATCATTGTATAGTATATCGCTGGAGCGTGCATAACATC
AAAAGGGACTGAGTTCTTGGTGAGGAACTCTGGACAAATGATTAACAGAC
CACAGAGATTTATGTTGGCTTCCCAAATTTGCTGAAGCTTTCAGAGATGC
CAATTTCTGGAGGTGGCTAAACAACTAGTTGAATGACGACATTAAAACAA
ATCAAGCAGTAGTATCAATTGTAGCTCATTATTTGGTAAGCACAGACCAA
AATCATAGCACCTATCAAACCCAAATCTGAAAAAATGTAGCATTTGTACA
AGACATTATACAATGCTACTACTATGTATGTTTATCATTTTCACTCTGAA
TTATATTTAGCAGTAAGTCACATGGATTTGGTAAAAAAATAAGGGGGAAA
ATGTAACGTGTGTGTAACAGCATGACTTTGATATTTACCCAATTTTATAT
TTTTCCCTCCAGCAATAATCCCCAGAGACAAAACTTCAAAAATATTTCAG
TATGAAATTGCAATAATGAAGATCAATTATTGTTAGTGGATAAAAAAAAA

FIGURE 26FF

```
AGTGGGTCCCACACTAATTTTAAAATTATCCACACAAAAGGAAAAACATG
TTATTTATCACATTCTATTTTTTTCTTCTCCCTTCCTTGTATTTTTCAGC
TGAAACAAACACAATGTTACATCTTTGTACAATTTCACTTTTCCTCTTGT
CAAGATTAAAGTCTAGGAATGCTCATGAGTCAGTTGGATGAGACATGATA
AGTTAAAGTTGAGAATTTACAGCTTTGTACATTGTCACTTTTCCTCCTGT
CATGATTAAAGTCTAGGAATGCTCACGAGTGGATTGTTGGATGAGACTTG
GTAAGTAAAGTTGAGAAGAACATTCGAATGTCTGGTACAATGCAGGAAAT
CATGCGATAATACCCGCAAATTGAAAAGTTGGCGACATAAATATGATTGA
ATGCTCCCAGCCACAGATAACAACAGTAAACCATTAAAGTACTATTCGGG
CGGTAAAAATTTAACATGCCATGGTTTCGACCTCAGTTTAAAAAAATTCT
TCAGCATAAACAGTATACATGCATGTTTTAATGTAGTAACATTTGAATTC
TTCGACATCTGGTAAACTGTTTTAACATTTTCCACATATATATCCCACAA
GAATAGGTTGGTGAGCCATTGGATAAAATTAAGCCATTGAAAAGCTTTCT
ACAAAAGAAAAAGAAATAAAAATAGAAGCTTTTATCTACCTGAGCAATAG
CTTCTTCACAAATACTCTTAAGGCCATCCAGATGATACTCATATGTAGCC
CTTGAGAGGTCCTAAGCAACATCCAAATTAAAATATCAACAATTCAATTT
CAAAGACAAAAGGTATTATACTAGTTTAAATAATGCAACTATGAAAATGT
AGAACAGACGGTTCAATGAATAAGGAAAATAAATCAAAATAAACAAACGG
GAAAAGCACACATATGAGTAAAAGTACCTGGGGAGTTGGTAATGGAAAAG
CATCAAAAGGAGAGACTAAACAACTTGCTTTGGCAGCCAATTTGTGAAGT
GCTGCTGAAGCATCACCCTTCTCCTTTACGCCCTTCTCGCTTGAAGATTT
AAGAATATCCAATAGCAATTCTAATCATGTACATTTAGCAGCATATTCAT
TGCAAAATACTTTTACCATCATGAGGAGAAGAAAAAAGTTTAAAATCATT
TATTATGAAAGAACATCCAAACGTTACAAATCATTTATTACCACTATTGT
CAATGAATATAGTTTTACCATCATGAGGAGAACATAAATAAACAAGAGCA
ATAGTTACACGTATTTGAAGCCCTTTTTCTAAAAAGCACATAACAGAGAT
TAGGTGTTCCAATACCTGCCAAAGAGGAATAGATACAAAAATCATATCCA
ATAACGTAAAAAAACATGAAAAAAATATCGTTCAAAAACTATAAGTAGAT
TATAATTCTCAATTTCACATCTATAACTAAACTAAATCACTCACAGAATT
TGCACGAAAACTCACTCGCCCTTGAATCTTCTTCTCTAATCTTTTTAATG
TGTTTGCTATGCAATCTTTCATAGGCTGCAAGTTAAACGACAATCACAAC
AAGGTGTTCTGTTAAGGAACATTAATAATGACTAAATTATAATTTAAGAA
GAAATGCAACTATATATGGTAAAAATGAAAATCTATTACTTTAATTACAA
AGAGTAGATGAACATACAACTAATCTTTAAAATGTCCATCCTTCGGTTTT
TGAAAACCACCAGCCATAATAATATCTACAACAATGTCCTATAATACAAA
GATGTTACATCAGTGGCCGCATATCACATTATCACTGCACATCGATGATT
TCTAAAGGGCAGCACACAATGCTGACAAAGTAAAGAACAAGGAAATTAAC
TTCACCTCATTACCAGCAAGACCATAGAGGGCTAAAGTAGCATCACGTTG
AAGGGGAGAATTGTTTGAGTCAATAATATTGGGCAAAGGCTCTATAGCTC
CATTTTAAGCAATAACAGCTACGTGGGTCCTGAAATTTGAATTATATATG
CAAAAAAGGGTTATGGAAGGAAAAATTATAAGAGGAAAAACCAACATATA
TATATATATATATATATAATTCGTGAAACAAAGGAGCATATTTTTTTTAC
ACCATTTGTATACATTTACCTATAAATTAAGAAAAATCCACCCTTAAGAG
TTAGGTTTAAGAAAGGCAATCCCAAATTCAGCCATAACTAATGACTGTAG
TGTTAGAGGAATCCTAAAGCCTACACCATGGAGTCCCCATTCAACATTAA
CCATTTGTAAGATTGTGTAGTTATATTATGAACACAGCCAAAGGATGGCA
ATAAACATGTTAATAATTGAATAGAGACTATGATTAGCAATCTATACCTA
AGAATAGCATCATGGCTTATCAAATATTAACTTTAAATAGGAGATTATTT
GAGAATTTTAGATCAGGCTAATTAATTACTGCTATGATAATAAAAAATGC
AATTTGAATTTTTAAATTTTATATTCCTTAACATATAAGCAAGCGACTAA
CTTTTTGTTGCTACTAATAATCACCTGTGCCAACCTCCCAATTGCAAAAG
CCGACATTTCCCGGAGCTCTACATGTGGAGACTTAAGCATGTAAACTAAT
GGTGGAATAGCCCCTCCTTGGGAAATATGGAACTACCACAAAGTATGGAA
GTCAATAAGAGGATTTCATAACTCATAGATTTATCATATTACAAGTTTGC
AATGCAGAACTTAATCCACCTTTAAATCTGAATTTGTTGCAGCAAATTGA
CCAAGTAAAAGGGCTGCTTGTTTTTTGCTTTTCAAACAACAAGAACTATC
ATTGAAATTATGAACTTGCAAAGAATACTTGGGGGGAGAAAATAACTAAA
CCATTAATATGAAGGTAGTATCTGATTTTCAGTAAACAACTATAATGTTC
AATAAACATATCATTCTTCTATATATGGATTGCTTAATGATTAAAGGAAA
AACCATGACCAAAGTATAGTGTAACCTAAGTAAACAAACGACAGGTGGTA
AAGCCCCGGCTAGAAGCACTTCTTTCATAATATCTGGTGACGAGTGGACC
AAATTTTCAATAACAACAACCTACAAAAGGCGCTAATACAACTAGTGCTA
GTAGTTTAGAACTCTGTAGAAGCAAACTAAAAAATGCATGCGATTGTGTA
AAGTCATATAAGCATCTTACCACTACATAACGTATTATAGGATCCTCTGA
TTGAAGCATTAGTACAAGAGTGGGTAATGCATTGCATCCAACAACCTGCA
ATTTTTTTATTGCAGAAAGTCAACTACCTTTGTGGCATTGAATTCAAGCA
ATTCAACAAGAGGAGGGATATCACCTTCCTTCCAGCATATACCATACCTA
TATAAGCATAAAGAATAGAATAGTTGTAGAATAAATATTTTAAGCCATG
AAAAAAAGGACAAAATCCTGACACGGGTCTTATTGGTGGTATTTTCAAAG
TCAAGATTGCATATTGCATCAGCTACTCTCCTGAGAAGACCGATAACTGG
```

FIGURE 26GG

AGGAGAAATGGTACTGATCTTGTGCTTACTTAACAAATCTACAAGACAAG
GCAAGGCTCCAACATCTATAATGAGTTGTTGACGCTCTGGTTGTTTGATG
ATAAAGATAAGAAAAAATTAAAATCAGAGTTAAGATGCTCCATGATTACG
AGGGATAAACAAACGTGACTTGAAACTGATTTTATTCTTAAACATATTTT
TGGAACCCTCGTACCAGAAATTCAAAGACACCCATAATCATTTTCCTCTA
AAAAAGGGCCACACTATTATATACTACTGAAAACTCAAATAGAAAACACA
TAGAGACGTTACATGCACGCAGTATGGTTGATGTATTTAATCCAATACAC
CCATATTCTTCACTTATATGTTAATTTGGATAGTAATTTGTATTATTATT
TATTCAAAAATCACCCTTAAAATTATCAAGACTCTCCATCTCACTTTTTC
ATTTAATTAATTAATGTGTGCTAGTCATGTTATTGGATGCATCCAAGATT
TCATGGGCCGATAACAAAAAAAATAATTTGTACCCTTTTATATTTAAGTA
TTTGAAAATATAAAGATATATTATTTAAAAAAAGTGGATACATAGTTTGA
TTAAAAATTACATTTTTTTACATTAAACAAATAACATAGGTTTAATGAAA
CTCAAAATGATATATATATATATATATATATATATATATATATATATATA
TATATATATATATATATATATATATATATATTGCATGTTTTTATTCAATT
TACTCTTATATTATCATCTATCATTTAATTTATTCATAAAATAATTACAT
AACATAAATATTTATAAACATGACAATGGGATGAGTCGATGATAAATTAA
CTATCCCCAACATTTAAAAAGGTTGATTTATATTTTTTAAATCTATCTCC
ATTCCGGTTGAGTTTTATAACTTCGAATAAAGCTATAAGAAACTCATCAC
ATCCTTTATAACTTTAATTTACTTATATATTTATAACAATTTAATTTTAT
GTTCTGTCTATCAAAGAAAGTATTCTGTTAGGTCATTATTTTTTATCATC
AACAAGATATCATTTCATATTAAATATTTCATATTTTTGTTCATTATTAA
TATACTAATGCTTAGTTTTTTCATTTATAATTTGAATTTTTAGTTGTTTC
TTATTTTGTTAAAAAATAAATATTTTAAGTTTATGATCATATATCAATTA
CACATTGATATGTTGTAGAGTGAGCTAAAAATTCATTCAGTATGCCCTTA
CAAAGATAATAAATAAAAAAGAAACTAAAAACTAACATAATAATATTTTT
TAAGTCACACCTCACATCTTAATTGAAGAAAATGAACATAAAATAAGATA
ATAATTTTAATTTAGTTATAAAAGTAAACTAAATTAATATAAAATAATCT
ATTACACTATAATTTTGAATCCCTTTTAGGGATGAGTCCTGTGAGAGAAA
TAGTACATTCAAGAGCAATTTCAATGCATTCGTCCCCTTATATATTCAAT
AATGACAATATAATATATAGCATTAACTAAGATATTTAGGGAGAAAAGGA
TGAGTAGAACTTAATTACTTTAATAGCAAGAATTACAAGGATGTGTGCAT
ATTTGTTCTCCACCTCATGCTTCTCAATGGTCTGTCACTACTCGAAAAAG
CATTTTTTACGATAGTAAAACGATGACGGTTCCTCAAGAAGGAACCATCT
TAGTATGTAACGCAATGACAATTTTGTAAATATGGGATCTTAGAAACTAC
CCTTCCACAACGGTTTTGCAAAAACCGTCTTAAAAAACCGTCTTCGAAGA
GAATATGTTTTTAATTTTTATATCTCCCTCTTGAGAGCTTAAACATTTGC
TCTCCCTCACTCGCTCTTTCACTCTCCATAAGCGAGAGCCACAGAGACCT
CTCACTCTCACTCTTTCCCTCTTTCCCTTTCAAATCCCTCTTTCACTGAT
TGTGGTTTTTGGTGCTGCACAACCAAAACCTGATATCCAGATCCCTCTTT
CCCTTTCAGATCTGAATGCGTATCGTCCCTCCCATGGCTTCAAAGCGCAT
CCTCAAGGAGCTCAAGGACTTGTAGAAAGACCCACCAACTTCTTACAACA
TCGATACCCCTTTTTTAGTGGATATGGTGCTTCTCTATCAAGTTTTATTC
TTTCCACTTCCAATCCCTAATTAAGTGCCATTATTTTCCCCTTTTCAAAA
CCAGTTCATTTCGCTTACCAGTGTTCCCACAATCGAAACAAAAGCTTTCC
CATTTTGCTTCATCGTGCGAACAAGCTCCACCCAACCCTATGTCGAAAAC
TTAAACGTTCGTTGCTCAAAATTAGACTCCAAAGAAAAGACATGGCCGCA
AGAACAGTTGCCAAAGACATAATCACTATTTGCGGTTCCGCAACAATCGT
TAGTGAGTTCTTCGGTATTCATATCATTTTTCTCTTTTCTCGCTTTCCTC
CGATTTCTTTGATTTTTGCATACCTGTGTATTTTTTGTGAACTTTTGCCT
GATCTTTTTTTTGGTGATTTTTTCAAATTAGGATATGCTGCCATCAAGTT
TGATCCTTGTATCCTGCATTTTTTAATTTATTTTGGGCCTTATTTTAATA
TGGGAATTTGATCAACAATCTCTACAACCGTGGAGTTTATCCAGAAGAAA
GCTTTGTGAAAGTTAAGAAATATGGCCTCCCCATGTTGCTAACGGAAGAT
AAGGGTGTTAAATCTTTTCTAGTAGATCTAACCACTCAGCTCTCTGGTAA
CTAACATCCCTAATTTGTTTCTTCTGTCGTGGTTCTTTTTTCATCTCTTG
GAAGCTGTAGAGAAATGACAATAAGTCATTGTTTAGTTGGAAAGTATTGT
TTTTGATTAATTTATTCATAGTATAAAAGTTCATTTTAAGAAATGGTTTT
GAATTTGTCATCATTTTTCCCAAACTGTTTTGATTTTGAATGTGTCGCGC
TCTAAATTTGCATGACATATTGTCTTTAACTGAGTCAATTTTGATTAATA
AACCCTTTCTTCACTCCTCTGCTTTGTCAACCCAACACCTACTCCTGTGT
GTGTGAGTGACTGAGTGAGTTTGTTGTAACAACCATGCTTTTTTTTTTTT
AAGTTTTCCTATAAAATAAAATTAATAAATTAGTAAATAAATAAGTAAAA
GTAATTAGGTCATAATTTTCCACTATATAAACCAAATGTTAACCTAGAGC
AGCTTTTATAAAACACTTCTATTTCTTTCTTCTTTTTCTGACGCACAAGA
ACCCTATCAGAACAACCAGATGAGGAGCTCTAGAGAGCACCAGAGATGCC
ACAATTGCTAATGGAGAACGTTTGAGCGACTACATCGAGGTAAGGGATGA
GTTACTCACGCTTGAGGATTAGAAGAACATGTATAAGGATTTCTAGAGGA
TCAATTTTGGGGTATTTTGGGTTGTTTTTATAAAATGTTAATTCATGATT
CTTTCAAATTGAATAATTCTTACGCTAAATTGAGTGTAATATCTATTGTT

FIGURE 26HH

ATGAAATTCTATGATCCTGTTAGTATATATTGATATGATATTTTCTTGGT
GTATATTAGATTTTTTTAATTTTCAATTGTTATTACTTGATTTCTTGTTG
TATATTAACGTGTATGATTTTCGTTGTTTTGCGCTTGTGATTTATTTTTA
TTTTTTGAATGTGTTAGTGAATTGTTATCATTGGAATGAAAAATTTGACC
CAAATAATTGTATTGTCTATTGTTTGTAATGAACTACAATTTATTGTCAT
CTTTTTCCCTACTATTATATTTGGAAGTTTTCAATTGAAATAAGAGTTGT
TTTCCCTGTTTGGGAATCGTTGCTTTAAATTTGCCACAACTCTTTTGAAA
ATAGTGTAAGACGTGTATGTAATACTTGTTGAAAAAAAGAACAAAAAAAA
AAAATGCAAACCAACAAATTAGTTATACATTGTTTATAGTTGTCCTATTT
GACTTGACTTAGGGATTGATTTTAGTATAAAATATTTTGTAGTCTCAAAA
ATATGTTTGTTAAATTAATGGTTTGACTGCACCTTTTAATTTCAAATTTT
TAATTTTTCTTGACAAATTTGTTAACAAACTAATTTGATAGTCTAACAAA
ATTACAACAGAAAACTTTGATACGTTAGGGCGCAACAAATATGCTTGATA
TGTTACTGTTTTCTACATATTAAATTGATCAACAAATTACAACATAAACA
TTCTTTTTAAGGTGGAAAAAAATGCATACGTTAATATTTCTTATAAATGA
ATTTCAGCCGTTAAATATTCCCTTCAAGGTGCAGTAATAATATATTTAAT
ACGTTTATCATTAAAGATATTATACTTGTAACACATGGTTTTTGCTTTTA
ATATATATATATATATATATATAATAAATTAAATGTTGTTGTGAATGTATTA
TTTTACTGCTCTGGAGAAATAAATTAAATATTTTGTGACATTATTATTTT
TTTATTTTTTTAGTTATATATGTATAATAATAAATTAAATACTTTTGTAA
AATTATTGCTTAATCATAATTATTTTTGCCACATCTCAAATTAATTGTTG
TAGATATTTTTATTTATTTATTTTGTTGAATTAATATATTCGGTTAATCT
ATATTTTTATTGTGTCAAGTAAATGTTACTATTGAATGATATGTGTAGGA
TGCGTGAGATGCGATAAATTATTTTATTATGAAATTGTGGTTGAGACTGT
GTGTAAGTGATAATCATTTAGTACATAATGGATTGTGAATTACATAATTG
TTGAGATGTTCTATGTTTTGAGTTGTGAGCCATGAATTATGTAATCACAC
AACTGTAAGACCCTTTAAGGGCGACGAGTTAATGCGCAAAGAGTTGTGAT
GAGATCCACTGTGGGAACCCGACGAGTTTAATCACTTGAGGTGCACTGAG
TTAAAATATATTTTAAAAATATACATACATACATATATATATATATATAT
ATATATATATATATATATACACACACACACAATTGAGTAGTTGTGTGCAT
TGCATAATTCATAGGTAGAGTCTATGTGTTCAAATTTTTTTTTGGGTTAG
ACCTGAATCAGGAGGGAGAGGCCCTGACGAACTCTTCGGAGTGTAGGCCT
TGGGGGTCATCCGATTTGAGTGCTCCTTTAAGCCTGTGCCGCTCCCACAT
GGTTGGAGCATTCTCGCAAAACAACGTGATCCTGACTGGTCTCCCTATGA
TTTCACTTAGTGAAAGTGACCTAACTTACCCATTGTGAGGCATGTCCTGT
CATGTACTCTTAGGCGCCCAACGAGGTTTTTCACTGAAAAATGGTACCAC
ATTGCATGTAGGCTTAAGTCTAGAGTATTTGTTGCATAATGCATGTGTTT
GACTTTCATTGAGTTAACAATTGTGGTTTGATGTTATTTTCTGGAGTGGA
TGAACTTGAATGGATGTGCAAAATGTGTGTGATTTTGGGAAGTGATGTTA
ATTATATAAATTCAGCTTTAAGTATTATATGTTTTACATGCTCTAATATT
TTATTATATATGAATGTGATAACTCATTCCTAGTGTGTGTTTGTGTTTGG
GCTGATTGTCATTTGTTCAGGTGAGCCATCACATGATAAATTCCATGTTA
GAGCCGGAGAGACTTAGTCTGTGATAGAGACATGCTCTGATAAGTGTGAC
ATTGGGGCATAGGATTTTACTTCGCATGTTATATTTTCCGTAAACGATAT
AGTTGTGTTATGTTTTCTGTTTTAGTTTTTTTATTATTATTATTCATTCA
GCATGGACGACCTTGTTTTGAGCCGGGATAACTTTGTTGTTTTTATTCGA
ACAATTTCTACTATGTTTTCATTAAGTGAATGTGAACCCTTTATCTTTTG
AAATCAATTTAAAGTCAATGTGTTTAAAAAAAAATCCGCATGATTTTATT
TCCTTTTATTCGTTATTTGTGAGGGTAGAGGGTGTCACATTTGTTTTTCT
CAGCTGATATATATGGCGCTTCATCGCTCCATTATAAGCAAAACGACGTG
GTACAATGTCCTATTATGGATGATGGTGGTGCTCGTGAGAGTGCACGGTG
CAGCCGCGAGGCTGAACCGTAAGGAGTGGGACTCAGTCATAAAGTTACCG
ACTGAACCGGTGGATGCTGACTCGGATGAAGTGGGAACACGATGGGCGGT
TCTCATGGCTAGTTCAAACGGCTATGGAAACTACAGGCATCAAGTAAGTT
AATTTGGTTTTGGTGTTTTTATTTTTTTGGATTGGTTTAAAGACCAAGGT
GTCTCCTTTTATTTATTTTCTAAAATTAATTAATTAGTTTTATGTTTTGA
GTTGCTATGTGTTTTTCATTAATGGTTTTGTTTATGGATGTTGTGATGAA
TTGAATTAAATTATAAACAAGCAGATGTGTGCCATGCATACTAGTTGCTG
ATAAAAGGTGGACTAAAAGAAGAGAACATAGTGGTGTTTATGTACAATGA
CATAGCTACCAACGAGTTGAATCCTAGACATGGAGTCATCATCAACCACC
CAGAGGGAGAAGATCTGTATGTTGGTGTTCCTAAGGCGAGTTTTTTTTTG
GTTGATTCTCTAACGTATAATTTAAGCTAGCAAAATTAAGTGCTTAAAGA
GGGATTTCCATAGCTGCTAATTAATTATGCTACCATTGCATGTCATTCTT
TCTTGTTTTTGGCTACTCTCTTTTCTTTTCTTTTTTGAAAATAAAGTGGT
GCAACATGTCTGTTCAGGAATGTGCGATTTAGACTCTTTTTTTTTATGTT
TTTGAAGTAGAGTAATTATATATTAACGTTAATTTATCACAACATCCTTT
GAACAAGGATAAAAATAGGAAGAAAATAGAGAGGTATGTGAAATAAAATG
GACTATGCAATGGAAAGACAAAATGATTTGGGATAATTTAGATCATGAGA
AAGAGTTGTCATTCCCTGAGCATCTCGTCTCTTGTTGCTACAATTTTTGT
TTATAGCTAACGTGCCACCTCTCCCTTGTTCAGATCAATGATGCTAGTTT

FIGURE 26II

TTCCTCTTCCCCTTGCTCATCTCAAATTCTGTGGGTCCAACCCAGATTGC
CTTGTTCTGATTTACTCCTTTAGAGACTAAAGTGAAAGTTATACCCATT
GATTAGAAAATCAAAGGTTGAGACTTGAGAGATTTAAATAGCTACATATT
TTATTAAACATTTGTATGCATTTAATCATGATCTGACAATTGATTTTTC
AATCAAATAACTCATCACTTTACTCTTTAAAGTAAGTCCTTCACTTAGCA
ACTTCCTTTTGTTCACGACACAACTCTAAAGCCTTCAAATATTTTTTTTT
GTTTTAGTTTTTCTACCAATTTACTAAATAATTCTTCTTCACTTTCTCAT
GCCTGTAATACCGGGAGGGGGGAGTGCATCTTATGTTTGATATAATTTCCC
TTCTGTCTTGATTTTCTTTGTGCTAGGTTGACATTCATTATGGTTATTTC
CATTGCTACTTGATTTATAGAATAGGCAAATATAAACTTCACATTTAATT
AAGAAAACCAACCATCATTGAATTATATGGAAATTGACATTAGTTTATAT
TATATGATTATTTTGGGTAAAAGTAACTAAAAGTTTAAAATTTAGTTGAA
AGTTAAAAACTTAGCTAGTAACTAAAAAGTGATAAGCTAGTTTTGTTGAA
TTAAAAGTAAATTTTTCTTAGCTAGTTTCTAAATTATTTTTAATAGTTGA
AAAATTTAGATTTTCTTTTGATCTAGATATTGGTCTTGATTTTTTATGAA
GGCAAACGACCAGTTACACAGATGGTTTGAAGACAACAATGCATTGAGCG
TGCCATTAATAAGGAGTATGTCTATGACCCAATATGAACGAATATCATCC
TTAGGATATTGCATTCCATATCTATATATCACATAACTGTTGTGTCCTTC
CTTCTCTTATTTATAGCTGGATTTTATTACCAGGTGGAGATGAAGCAGGT
CCTACGAAACCTATATGCCTAAGTCAAGATGAGATTAAACCCTGCACAAC
GGGTACGCCTTTAGTTGCTCATACTTACAATGTAGTTGCATAATCACATA
TTCTGGTATTGTATCTATTATGCAACACAGTAAAACGAAAAGAAAATTAC
AAGAACAAAAATAAAAAAAAGTTAAATTGCAAGAATGAAAAATGTATTTA
AATCAAAAATATATATCGAAAGAAATTAATTCCTTAAATAGATTTAAGTA
TTTTGATACTTGAGCTTCGGACTAAGATACCTGATTCCTTAAAACTGATG
GAATCCAAAGTTTCGCTTGGAGTGTAGGAAAGGGAAACATTGTTACAAAA
TTATATAGAGGTCTGGTCGTAGAGAGGTCAACTCTTGCTTGATATGGTAC
CTAGTTAGTAGTAATGCATCGCGTCAATATATATTAGGTGAATAGCTATT
CATGTATATTAATATGATACACATGCATTATAGTGTGTCGTGTGTCTTGT
CCAACTTTGCAGTGGTATATATGCAAATAATAGTCAACATTAATGATATT
TGTATATTATTTTTTAATTATATTTTCAACTAATAAAGAAGAATAAAATA
CAATTTAACATTTTTTACCACATAATATATTAAATGAAAGATAGTACAAT
AATATGAAGGTAAAATAGTTAACACATTAATAATATAAAATAATTATATA
GTTATTTTATAATAAGTTTTCATGATAAATTTATTAATTTTTATATTAAT
TATGTAATTTAAAAATCATACATAATACAACACTACGTCTAAGAACATCT
TATTTTTTTACTAATAATATTTTATGTTTGGATGAGTGTTTGTAAAATAG
ATTTTAATTAAAATTTATTTTCAAGTAAAATAATTTATATTTAGATGCTT
TTAAACTAAAAAAATTGCTATAAAAATTAATATAAATTTTTTAACTCAAA
ACAAAAACTATTTCTAATCACTTTTAGTGCACGTGAGTGAAGTTCCACCT
AGAAGGAAATTACAAATTATAACTTCTACCTTGCTTATTTATATTTGATA
CAATTTCATTAGATAACATGCATACATAATTATAACTACATTGTTTAAGA
CTTCCTATTATGCTTGTTTTAGGGGACAATATTTTTTGTTCCTTTTTTTT
TCCTTTTTTTTCCGTATCTATTAGCATGCAAAGTATATGAAATAACATGT
GGTTAGAATAGAAATCTAAGATTGATGGTAAAAAATGTATGAAATTTTAG
ATTTTTTTTTTTTAAAAAAAGAAACACATTCTAAGATAATTCTCTAAATA
ACTGTCTTAGAATCCTTAAAATATTTTTTTAAACAAAAAATACATTCTAA
GACAGTTTTTAAGAGAACCGTCTTAGAATGTAGAGACATTCTAAGATGAT
TTTTTTTTTTGAAAAAAACCGTCTTAGAATCCTCAATATATTTCATTTTT
TTAAAAAAAATACATTCTAAGACAATATACCATTCTAAGACGGTTTTTAG
CTAAAAACCGTCTTAGAATGATATTTTTTAAGATGATTTTCTGTGGAACC
GTCGTAAAAAGTGAAGACTTTCTAAGATAATAATTAAAAATCATCGTAGA
ATGCCCAAATCAACCGATGTAAAAGCTATTTTTTGTAGTAGTGTGTGGCA
GCGCCCAAAGATGCTTCACTAGAGCAAGGACAACACCGTAGTTGCTCACC
ATAGTATCCATGTAAGAACCCGTGATAAACAAAATGTGAAATCCTGCAAG
AGCACAAAATATTTAAACAAAAGGCATTATTAGTCGACGAAAAACAGTAC
CATTTTTGGACTTATCTAGTGATGGTGAGGAGAACCCTCTTGACGATTGG
AGGCGGAGTTTGAGAAATCAACAAGTTCGGAGAAAAGTATGTGAGATTCT
TAGGGATCTTTAGGATGTGGAAAAACATCAAGTTCAAATAAACTTGTTGA
GAAATCTTCTTCCAGGGTATAATAATCAAGATGCGGCTCCATGATATCTG
TTTGGTCTTCGGAGGCTTCCATGGAATTCACAACAACAAAATTAATTAAA
AAAGTTGGTGTTAGGGTTGGAGAGAGATCAAAACATCAAAATCATGCAGA
CCCTTTTATACTGTTTCTTGCCCGTCAAGGAATGCTGCACTTAATCAAGG
GAGTTCACCCACTCATCATTGGACCCGACCCAATACTAAAAACAAAATAA
CTACTTACAGTACAAAGAAACAAATCAATAAAAAAAATTATTTATTTATT
TTTATATATAAAAAGTTAAAATTTGATATGTGAAGAAATTATTTTTCAAA
TAGGAGATTATCTTAATTAGATTGTTGTTACATATGAAGATTTTATCATA
CATTTATTATGTACACATAACCAGATTATATGTTTAGATAATAAAAGTAT
TTTAATAATTTTTAAATCGGCAATTTATGTGGATAAAATTATTTGATATA
CAATTATTTTGTATATATAAAAAAGTTGTTGTATTTGAAAATGCTAATGA
TAAAAGTTTAGTATCTGAAATTTTAGTAAACAATGAAATCTTGATTTTGT

FIGURE 26JJ

TTTGTGTCAAATTTCAAATACACAACAAAATCATGATTCTATTATGTGTT
ATTTTTTGTAATTTTGATTTTTCATGAATGGTTCTTTGCAGTGTATACAT
GGATTGAAATACATCTTTTCTGATGAAGTTACAATGCCTTAGGGTTTTGG
AAACATGTATGATGATAGTCAAATTGTTTTTTACTGTCTCAATCTATCAA
ATGAAATGCTTGCAGATCAATCAAATAAAATGTTTGCAGATCAATCAGAT
AAAATGCCTACAGATCCTGACAATGGGTTGGACATTGACCTCTCCCTAAC
CTGATTACCCTAACTTTTCCAATCATTTCACAATTGATGAGATATGTAGA
TTAGTTGTCGATTGATTTTATATTTATGTATGTGTATGTTGCTTAAGTGA
AGAAAAATATTTTATTTTTTAGGTTTTTGAAAATTGATACAATTTGTTCG
GTTGGGTTTGAGATTTGTGGAAAAGTCTTCGATTTATTCTTGTCATTCAT
AGGTCAGAAAATGGAAGGAAAATTTATGTTGTAGTGGGTAGTGAAAATGA
AGGAAAGTACAAGCAAGATAAGGATAAGTTAGTTTGCAAGAGTACTAGAA
CAAAAAAATGTGGTTGTTCATTTAAATTAAAAGGGAAGTTTGTCAAACAA
GTTGGTTGGAAACATTTTGTTGTCTGTGGTGTTCATAACCAGAAAGTTAG
TGAAACATTGGTCGAACATGCATAGGTTAGTCATTTAAGCAGTGAAGAAA
AAACTTTTGTTGACAACAAAGATCAAGATAAAAAAAAATGTCACCACCAT
CAAGACCATATATAATGAATGACAAAGATATCAGCGAAAAAAAAGGCACT
ACTAAAAAAATAGTTTTTTATGATGCACCTTTGACGAAGGTCCCCAAAAA
CCGTCTTAGAAAGTCAGAAAGTGAAAATTTTGTAAATATGAGGTTTTTCA
ACAAAGACAGTTTTGAAAACTATCATTCCACGATGGTTTCGCAAAAATCA
TCTTAAAAGGTTTTCATTCTAAGATGATTTTGTAAAAACCATCTTAGAAG
TGAGTGTGTTTTTAATGTCTCTCCCTCTAGTCTTTTCTCAATGTCCCTCT
CACTCTCCAACTCCCCCTCTTCTTTGATTTTGTCACAATAACCCATACAA
TTCAATTTTTTTAGGGTTTCCAGCGACTGAGGGATTGGAAGAAATGTAGC
AATGGTTGAAGATTGGAATCAGTAGCAGCACTCTTCAATGTGTTTTACAC
CACTCAGAACACCTTCTCCGGCTTGCACGTCCGTGGACCCCACGACTTCG
ACCACAACACATTTTTCACGATCTAGAACAAAATCACCGCGATCAGAAGG
TCCAACAACGCAGAAAGGTGCAGTCGCGCGCCACCAAAGTGTCAGTCATG
GAATCGCGAACCGATGGGAAGACTGGCGGTTAGGACAACATGGAGGTTCA
ACGGGAACATGAACCCAAACTCGGCCTGGACACGTGTAAACTCCACGTCA
GAGAGACCATGCTGCACATGTATGCTTGAGTTGCGAAGGTGGTTTATGAC
CTTGTTTGCTAAGGAAGTGAATGAGACGACATCGTTACAGATCAGGACAG
ACGGGGCTGTTGTTGCTTGGGCCAATAACCGACTTAAATCGGCTATATGG
GTCGGGTTTAGACCGATCATCCTCCAATCCACATCTACCATTGGCCAATA
TATACTTATACAGTGAGGAGGTGGGCTCTTTTCTTTTTAAATTTTGTTTT
TTTTTTGTTTTTCCTTTTATGGGTTTTCAAGAAGTTTTGATTTTGAGATT
GGGAACTTGTGTTGCAGCTTCAACTTGGAGTGGATGAAAGCTACAATTTG
TTCGTTTGAAGAGCCCAAACCCTTTCTGGTGTTGGGGAAGTCACAATTGA
GGTGTGGTTTGTTTTTATATGACTATTTGTTATTCCATTACTAGAAAAGC
CTCTTTGGTGATAGTTATTTGAGACATACAACGACGGTTTTGAACCTTCT
TTAAAGTTAATGTCATAAAAAGTCAACACTTTCCATGACCGGTTCCTTAA
CCGTCTTAGAAGCATAACTTTCTAAGACAATTTTCACGTGAAAACAGTCT
TAGAATGTATTTTTTTTTAAAAAAAAAATTGAAGATTCTAAGATTGTTTT
TACGTGAAAACCGTCTTAGAATGTTTTATTTTTTTTGAGAAAAAATTAAA
AAAAATGAGGATTCTAAGACAGTTTTTGGGAAAACCGTCTTAGAAATGTC
TTTTTTAAATAAAAAAAATTGAGGATTCTAAGATGATTTCCTAAAAAACC
GTCTTAAAAGGTAGACTTTCTAAGATGGTTTTCTCCATCTTAGAATGTCT
TTTTTTAAAAAGAAAAATTAAAAAGGCCAACGAATTTTGTAAAGAAACTA
AGACAGAAAATGATCATGTAATTGTTGTCTTTTTTATTTATTATGTACTC
TAAGACAATTTAATGTTAACAGTACTACAATACATCTGACTAATTAGGTA
GAGTGAACTATTTAAATTTAAATTTAGTGAACTATTTAACAATTTATATA
CTATCTCCTAAACATAAGATAAGAGCATGTACCACAGTTTTTTTGAAGAT
AAACATAAATGCTTAACCCAATAAATTATTTTGAATGAACATGGTAATAA
TTTAGGTAACTTATTTTATAAATGGGGAAAAAAGTATTGTTAAATGTATG
TTTACAGCTTTGACAAGAACAATATCATCAAAGAATCAATCCATAGGAAT
TTTCTACCATTTCAATACAACAACCTACATTTTAATTAAGAGAAGCTATA
ATTACACAAAATATCATTTATGTTCACGACAAAAGAAACTAGATTAATTC
ATTAATTATGATAATTAATTAAGCTAATTAAGGCATTGCATGTGCTTATA
ATCAAAGGAGCAAATGGGAGCCAATAATAATACAAATACCAGCCTTTCCA
ACAATTTGGCACTTCCACTTGTACCTTTTGAAGCTATATATTAAAATACT
TGTGTTATCTAATATTTACTACAAATAATGATTCAACCAATAGACAATTG
TAAACAATCCCAATAAATGTGAATGACTATTATCACAATTACTTTGTTAA
TTTCTAATTTGGTAAAAAAATACTTTGGTACCTTGATAAATATTGTTGTT
TCTGAACACACCAATAAAAATAATAACAATCCGATCTCTCATAGCATGCA
TTGATCTCATTCATACAACACAGCAAAAAAAAAAAAAAAAAAAACTCAATA
ACAAGTTAACAAGTAAAAAACAACACAACACGAAAGAAAAAAAGAGCAAT
TCAACATAACCAGACAATATTCTTTTATGGATTTATGACAATTCCCCCTT
ATTATGCCAAAAGAAATTCCATTATTTTTGTCTATTCTTTTCATGTACTA
ATAATTATCCAAAAAAATTGAGAATAGCCAGTGCACTAGAAGCATTTGAG
ATTGGCAAATCATTATAGGCCATTTATATTTCACCAACTTATGGGTCAGA

FIGURE 26KK

AAAACATGTTGCTAGGAGCAATAGGAACAAAAGCCTCCTCAGTGACAAGT
TTATTCAAGAAAATCCACAAAAGTTACATATATTAAGTGATCTATCAAAA
TCATAAAGAAAAAAGAAATAAATGAAATGATTATTATGAAAAAATAACTA
GAAATCCTTATACCATAAAGACGAACACCCTTATATATGAGAAACATATA
TATTTAGTACTTTTTTCCTTTTAAGAAAGATTAATCTCAAGTCATATACC
TTGGGGGGTTTGATTCCAACCCTGACAAAAATCTCAAGATTCATTAAAAA
AAAAATACTACCTTAGCATTGTGCTGGCACTCACGATTTCCAAATAAAGC
CAATGAATCAACAACAACCTTTGATGGTTTCCCTTGTACTGAAATAGGAG
AATAAACCTGAGTATTCAATTTCGTATTCTGTAGATAAGCATTTGCTATT
GAGAAATAAATAATTTGTATTGTACAAAATGACAAAAAAATTACTTACCA
AAAATTACAGGCAGGATAATCAGACAAACAAGAGAAGCCATGCTCACCAG
AAATGAACAACCCAATGTATTCAACCAAATGCCTAAAATAAAAAAAAACA
AATGAACTATATAAACATCAAATCTGAAACAATTCATAGATTTGAGCTTC
CAGAAAGCTAGAATAGCATTAACAACACACATCTTATTTTATTATTGTCC
ATTTTCTTATCCAAAATATAAATGTTATAAGGGAATTGCGTTCTATTTG
AAATGTTTGAAGAAGAAAACATTTAAAAGATAATCTTAATCTCCAAATCA
AAAAGTAATAGTTTCCAAATGTCATTATGAATGGGACTTTTCATTTCCTA
TTACTAAGATGAAAAGTCTACTTAAAGGAGGCTGCTTTTAATGGATAGAA
ATTCGAACAAGCTTAATGGGGGGAGAAAAGCATTCAATGGAAAATATTTA
AAATAAAGTTAGTCCTCCCCAACACCATTTATTATGGCAAAAGCTAGTAT
ATAGGGAAACCATCTTATTTTGGGGCGAAAAAAAATCAATTTGCACTCTC
AGAGTTCATTACCTACATGAGCTCAAGCTTCCAAGCGACATAGGTGAGAA
TGTCGACAAGGTAGGAAATGATGAGTAGAATGGTGTCGGGGGAGTAACGG
ACGAGAAGCGCAATGATGGCATGAAAGAGGGAGAAGTTCCTCTAGAGGAG
GTTGAGGCGTGACTCGCCAGGGATCTAGCGGGCGCCAGTGATGACGTTGC
AGAGGTCGGAGCCGGTGGTGACGGAGGAATCGGTGGAGGCGTTGATCTTG
GTGCGATGGAGGAAGGCGACAATGTTCTGAAGGTTGAGCATCTCATCGTA
GAGCTTGTCGGCATTGGTGTTGACAGGGACGAACTCATCAGTGACAAGAT
GATTAAATTTGTTGTTATTGCAAATGTAGAAGGGAAGGGAAGATGAGGGT
TTCACAATAGAGAGAGCAAGAGAAAGAAAGTGAGAATAAGAGAGAGAGAC
CTGATAAGATAAGAGAGAGAGAGAGAGAGAGAGAGAGAAAGCGTGAATTTGA
AAAGGCAAAACCATTCAAAGACAGTTTTGTAAAACCATTTTTGTATTGTG
TTCAATTACGACGGTTTTTTGAATAATCATCCTTAAATTCACAATTCCAA
GATGGTTATTTGAAAATCGTCTTCGTTATTAATGAACTTAATTATGACAT
TGTCACCACATTGTCTTCAAAGATGATTTTTGTCAACCATCTTTGTTGGC
GCATCGTAATAAATAATTTTTATGGTAGTGTTTGTTAATGGATTTGAATA
TTCAATGAGATTATGTTGTTTGTTGGCTAATGGATACTTAAATTCTGAAG
GTTATGTTGTACTTTTCCCTTCCTAAGTTAAAACTAGTTTCCTTTTATAT
ATGTATTTCTTAGTTTAATGTCGTAATTTTCTGTGCATTGAACAAGTTAA
CCAATCCCATCAACACCATTCTAAAATGCCACATAGTAGCAATTGGAATT
TGTTGAAACACTTGTTCATTGAGTGTTTTGTTTTTAGGGAAACAAACTGA
TTGATAAAGAAGACTCTTATGATGTTGTGCTTCCTTTCTTATGGTTAATG
GACAAAAACAAATAAATTGCAATATGTGGTTTATCTTTTTATTTCTTTAA
TGATAGTCATTTCTAATTGGCCATTAGTCTTTTAAGTTTTTTGTGATTTT
ATTTATTCTAGGCAAATACTATTTTTGGTGCATTGCGTGGATTAGAGGTA
TGTAGGGAATTTGCATCACAATCAGCTCAAAATTCTCTTCTTTGTCCTCT
TTACTATTTAGCACAAAGTGGAGGGATAAAAGGAGTTGTACATACTAGAT
ATTTTTGGATAAATTCTGTTTTTTATTTTTTATTTTTTAGATAACTTTCA
AATTTGTGTGCAATCTCATTTTTCATAATTTAGGTCTGTGTGCTTCTCTA
TATGATTGGTCAAATCTGTAATTTGCTTTATTCATGTCTATTGGGCAAGA
TGTCAACAGTTTTAAAGAATGTAGTTCTTGTCACTCTTAATTAGTGAAAT
TATGAACTAGCATTAACATATATAACTATTGGTATATACATAGTAAGTTG
CTTAAACTTAATTTTATTATATATATTTTTTCACCTTTAAAATGAAAGTTGA
ACCATTACTATTGTTGTGTTTCTCAATACGCATTGCGGACAAAAGAATCA
CTACCTTCTGAAAGATTTAAAGAAGTCTACCTTTTTTTTCATTTGAAATG
CTTCTACTATCGAATATTACACAATATAGTTAGGGATAGGATGAGATACT
TTGCAAAGAACAAAGTTCAGGTTAATCCAGAGATTTGAATGAGAGTTTCA
ACTTCTAGATCAGGAAGACTTGGAGAAACGTTGAACGAAGGATGCTGATT
TTTTTTTATTATAATATAAATTTATAACCCCCTTTTCTATGGATGGATGC
ATTTTATCTAACAAGTGGACCCCAAAGTAGTTGTCATTGATTAAGAAACA
TAATTGTTTTATGTGTAAAATTGTTATGCCATTTGATCAATGCTTATCCA
TTATTAGAAGTACTTTCAAGGGAATTTCTTGTGTGACTGCTTATTGCCCA
TTCTTTCTTATTTAAATACTTGATTCCTTGTGGTTTAATGGATCAAAATT
CTTCAAATATAAATCTTGTTCTTATTTAGTTTGATTATATTAGGCTTCTA
GGATTTGTATCCTCACGGTTTTTTCCCCTCAGACCACAATGTCTGCTATG
TAGGGAAGGGCCTACTAACTTATTTGAGATCTATTTTTCTAAGCATAAAT
TTATAATTAAAAAGTAATAACCTATTTTTAATTATTATTGTGATTAAAAT
TAATGAATTTAATTATTATTTATGATTGAAAAGGTGAAAAAAACTAATTA
ATATACTATTTTCTCTTTTTTCAAAATATAAACGTGTTGTGGAATGGGTT
GTAACAAGGTTCTTAATCTGCTTTGTGTCTTCATCTTCTTTGTCTTTTTG

FIGURE 26LL

TTTATATCTCCTTTAGATCTGTGCCTTCTTTCCACTAGGTAAGGTTCGAG
ATTACTTCGCCCTCGTTCTGTGGTTTTCACTAAGTGAGTGCTCTATGGTG
CAACTATGCAAATTTTAATTTATATTCTTTGTGGCAATGTTTGGACTAAT
TGTTTTAGAATATTAGATTAGTTTATTAATTGTTTTTTTGATAATATCTT
GCAATTGGGAGGTTGTATTTTCTTGATACGGTAAATCAGTGATACCAATG
GTGTAATGGTCTATTCTAAGTAATAAACTTTACCTTATAAATCTATCAAG
GATTTCATTTTTGACATTGTTATTATTTTAACTTTGAATATGCTTTTAGA
TATTAAGCTAATATTTTGTTTCAAAGATAAAGAAAAGATAGAAAGTTTTT
ATATTATTATTCAATAAAAAATTATTATATACATGATAATAAGTTTATTG
ATTTTTATAAAATTATTTTAAAAATCATACTAATGATCTTTTATAATTTG
TAAGTAGATGAAAGTCTTACAATGTGAGTACTTCATTATTAAAAAATTTA
TTAGAGGATATTTTCATTCTTGATTAATTAATCTTTGCAATTTGTTTATG
GTTACAGGGATGAGGCATCCTGATCTTCGTCTGAGATGCTTAGTTCTACA
TTGCCCAGCGGTGATGAATCAACCTCTTTGAGTAGTGTATTGAAGAGGCA
TCGAGTTGATCAGCGAAATTATTGACCCTTGGTTGAAAATTGAAGAGGTT
AGAGGTGGTGAAGGTTTATTTTGATGAACCCAATTCGATTAGAAATTAAT
CTTGACCGTTGAATTGATGGTGATAATTTAATTACAAATTATGTTAAGTG
CTAACTCTCATCTTTCTCTTGAAACTACTTAGTTTATAGGACAACTTTAA
TTTCAGAAAAATTTAGTTTGTTTTTCACATTCAATTTTTGTAGTCAACCC
CATTGATAATAACTTTGTAGTTCACATTTCATGATATATATGTATGTGGA
GAATGTATATATTTCAAATCCTACTACATTCATTTCCATGATAAGAAAAA
CTAGGTAGATTTTATATAAAAAAATTATCATATACCTCCTTTATTATTAT
TGTAAATTGTTTGTAGATTCACATATGCAAAACATATAATCTTTTATTAT
ATTTATAACTTTTTAATTATATTTAAATAAAAATAAAATAATTTTAGGTT
TATATTTTACTTTCAATATATTATAAACAATGATTTTGTTTCCAAATAGA
AATATTATATTTTTAAATAATTAATTCATAAATAATAAGCCTCAATAAAT
TTTTGGTTTGTTTAGAGACTTTCCAAGATAATTCTTTCAGAAAAATGTCT
TAGAAATATCATTTTTTTAAAACATTTTTAAGACAAAAAAACACATTCTA
AGATGGTTTAAAAAAGAACCGATGTAGAAATCAAGATGCTAAGACTGTTT
AAAAACTATCGTGGAAAGTGTTGACTTTCCATGATGGCGACTTCAAAGAT
GATTTTTGAACCGTCATGAAATGTACTAAAGAACTGATGTGAAAAATGCT
TTTTCTAGTAGTGAGGGGTCCATGAACGAAGGTACAACATCTACTAAAGT
TGATAGAGCACAATCAATATGTATATTGATTCAAAAGAGTGGACACTCAA
GATGTTGTCAAAGATATAATGTAGTCTCATCCATATTTCATCAAGCTATT
AAATGCATTCCCACAATGTTGATTTGTGATACTACTTGGAAGACGAACAA
ATATCATCTTCCACTATTGGAGATTGTTGTGTACTTCAACAGAAATGATT
TTTTTTTTTGCATTTGCTTATTTACAATTTTAGAGGATGAAGAATTTTGA
ATGGGATTTAAAAAAGGTCAAAGGATTGTTTGTGAAGGATGATATGCTGC
CTCAGGTGATTGTCACTAACAAAGATCTTACTTTGATGAATGCATTGGAG
GTTGCCTTTCCTTTTGCAACCAACTTGTTATGTTAATTCCATGTTTCTAA
GAATGTCAGAGCAAAATGCAAGATACTCGTGACTAATGCAGAAGACTGGG
AGGTTGTGATGAATGCTTGGGTAGGATTGGTGAATTCTATTGATGAACAA
ATATATGAGTAGTAGTTAAAAAGCTTTACAAGCATTTGTAGACATTATGT
GGATTTTCAAGAGTATATTTATTATACATGGTTGTTGCATTATACGGAGA
GATTTGTACAAGCATGAACTGATTGTGTTATGCATCTTGGAAACACAACT
AATAGGTAGATTTTTGTAATTACTTACTTGTTTCACATTTTGTTTGTTAT
GTATCTTCTATTGATATTACATTAAACTACTTTACAGAGTTGAAGGCGCA
CAAGCAAGACTAAAGAGGTTGTTTCATGATAGCATAGGAGACTTGTGTAT
TTGCTGGGATGCAATGAATAACATGCTTATACTGCAACATACTGAACTTA
AGGCGTCATTTCAAAAAAGCATCAACGTGCTTGACCACAAGTTCAATACA
CCGTTTTACAAAAGACTACGAAGCACAAAGTTTTAATTGTGTTGAAGCGC
TTTGCTTCCATTAGTGTTGACAGTTTTAATTGTGACTGCACACTCAGAAC
TATTCATGATTTACCGTGTGCCTATAAACTTGCTAGGTATAGCCAAATCA
ATGGTTCAATACCCTTGTTGTCCATTCATGTGCATTGGAAGATGTTATTC
ATCAATGGTACACACAACGCAGGTGATTCTTGGGGGGACTTAACTCTCAC
AAATGAGGTTGATGCATTGGTAAAGAGATTTTCATAGCTTGATGTGAGCA
TAAAAATGACATTAAAGAATAAGGTCCATGAACTTGCATTTTCGGATACC
ACTTTAATAAGTTTGCCTCCAAAGAAAGTAAAAACAAAGGGTGCATTGAA
GTCTGTGAAATCTACTAAATGTGCTCCTTTAATGTGAGAACGAGTTGGTG
AAACATGATGGTTGGTAGTTTGAGAACACCAAGTGTGGCTCGCAAAGAAG
TCAGTAGCAAAAAGTGGACAAAAAAAAATCCTTTATATGAATGAATTTTC
CCTATCTGTTGCAACAGTTCATGTAAAAGTTGTTGACATTAGACCTAATG
GAAATTGTGGTTATAAGGAAAATGCAACCTTACTTGTTATACAAGTGGCC
TCAATAACTTAAGAGGGGGGTGAATTAAGTTTAAAAAATTTCCCCTAACA
AGTTTTAATTCTCTCTTTAAAAGAAATATGTAGACTTAATATGCAAAAAA
AGAAGTAATGAACAATTTCCTTGATGCTTCTTTAAATATGCAAAGTAAAT
ATTAAACTGCAATAAAGTAAAAGAGTTTAGGGAAGAGAGAATTGCAAACT
CAGTTTTATACTGATTCGGCCATGCCCTATGCCTACATCCTGTCCTCAAG
TAATCCACTTGAGATTTCTACTATACTTGTAAATTCC
TTTACAACTTCTG

FIGURE 26MM

AACCACCCAGGGATATCCTTCCCTTGTGTTCAGAGAACTTACAAATCAAG
AGACCCACTGCCTCTTGATTACAACAACAAATTGCTTTTGAAGTACAAAA
GATGTTTTTCTCTCTTTAAGAGAATGATACAACTTGAAGAACTTATAAGA
ATCCTTAATGATTTTGCAAGTGTTTGGCCAAAGGTTTTCTTGTGAGAGAA
TAGGACAATGAATGTTCTGAAAAATTCTGAAGAATTTCGAACACAAGTCA
CATATTTATAGGCCTTTGGTGACCTTTCAAAAAACTTTGTGAAGAGTTGT
GACTTTTCAAAGTTATTTTTGAAATTTCCTCACTGGTAATCAATTACAGA
TATGTGGTAATCGATTAAACAATTAATTTTGAGGAATCATGACTTTTCAA
TTTAAATTTCAAAAACTTTTGTGATTGGTAATTGATTCTGAAAGCTTTTT
GAAAAACATTTTTGCTTCTGGTAATTGATTACAACAGGCTGTAATCGATT
ACCAGAGAGAAATACATAATTTTCAAGATGTAATATTTACTTAAAAACTT
TATAAGATATTTGAAAACTTAAGTCTTTTAAGGCCAAACCTTTGTAACCT
TTTTAAGAGATTCTTTTAACATATAAAGGACTATTGTAAATTGTTTCTAT
TGATTTCTTGATCTTGACTTGAATCAACGTTGAATAGCTTTAATCTTTTG
GCATCATCAAAATCTTCATACAACATATGCACTTACAATCTCCCCCTTTT
TGATGATGACAACAATCTGAAAACAAGATAAACGATATTCGATTTGCAAT
GCATGCACTCACCCTTACTCCCCCTTAAATTTGCAATTTATTGCCTAGTT
TTAGATAAGATCCACCCTTAGTTTCTCTACCCTTAGGAAACATCAAAAAG
CTGAAAAAGACAGAAGAAAATATCAAAGCCACAAAATATCTAGAGCAAGC
ATCACAACCAACAACAAAAACTAATCATCCATAGCAAAATATAAAATAGA
AGCAAGTGCAAAATATTCAAAGCAAGGCATAAACCGGGCCAAATGCTAAA
TATCCAAAGCAAAGCACAAAATTAACCAAAGTGATAAATAACAAAATCCA
AATACAGGGCACAAATAGTAAAATGTCTAGAAAATTAAGGACTTATAATA
CTAGAAACGTCTAAGAATCCGTAGGTGATGACAAAAAGGTGATTCAAAGG
TATTTTGATGATAACAATGATGATAACAAAAGATGGTGACAAAGGGTGAT
GACAAAAAGCTCAAAGATCAATCAAAGAACAACTCAAGTGAATCAAGAAC
AATTCAAGAGTTCAAGATAAGAATCAAGAAGAATTCAAGACTTAAGAAGA
AAGTTTAGAGTCAAGAATCAAGATCAAGATTCAAGAATCAAGAGAAGGCT
TAATCAAGATAAGTATGAATTTTTTTTTCAAAAATTGAGTAGCACATGA
TTTTTCTCAAAACATGTTTACCAAAGAGTTTTTACTCTCTGGTAATCGAT
TACCAGATTGTTGTAATCGATTACCAGCAGCAAAATGTTTTTGAAAAAGT
TTTCAAATTGAATTTACAACGTTCCAATTAATTTCAAAAATCTGCAATCG
ATTACAATGTTTTGGTAATCGATTACCAGTGCCTTTGAACGTTGAAATTC
AAATTCAAATGTGAAGAGTCACATCCTTTCACATAAAAGCCTTGTGTAAT
CGATTACACTGATTTGGTAATCGATTACCAGTGATTGTTTCTGAATAAAT
CAAAAGATGTAACTCTTCAAAAGGTTTTTGACTTTTTCAAATTGGTTTTA
AGTTTTTCTAAAAGTTATAACTCTTCTAAATGGTCCTCTTGGCCAAACAT
GAAGAGTCTATAAAAGCAAGGCTTTGATTTTCTTTTCAATACACTAATTC
ATACAATCCTTTACAAGCCTTGAATCTCTTTGAACTTCTTCTTCTTATTT
GTGCCAAAAGCTTTCCAAAGTTTTCTGGTTTTCTAAACCTTGAAAACTTG
TGCTATTCATCTTTTCATTCTCTTATCCCTTTGCCAAAAAGAATTCGCCA
AGGACTAACCGCCTGAATTCTTTATGTGTCTCTCTTCTCCCTTTTCCAAA
AGAACAAAGGACTAACCGCCTGAATTCTTTTGTGTCTCCCTTCTCCCTTG
TCAAAGAATTCAAAACGACACAGTCTGAGAATTTTTTTGATTCTTCCCTT
TCCCTTATACAAAAGTGTTCAAAGGACTAACCGCCTGAGAATTCTTTTGT
ATCCCCATTCACAAAGTATCAAAGGTTTAACAGCCTGAGATCTTTGTCTT
AACACATTGGAGGGTACATCCTTTGTGGTACAAGTAGAGGGTACATCTAC
TTGGGTTTAACTGAGAACAAGAGAGGGTACATCTCTTGTGGATCAGTTCT
AGTGGAGGGTACATCCACTAGGTTCAAAGAGAACAAGGGATGGTACATCC
CTTGTGGATCTTTGCTTGTAAAAGGATTTTTACAAGGTTGAAAGAAATCT
CAAGGACCGCAGGTTGCTTGGGGATTGGATGTAGGCACGGGTTGTTGTGG
AACTAGTATAAAAACTCTTGTGTGTTTGTCTCCTTCTTCCCTACTCTTTT
AATTTCCACTGTGCATTTTAATTTCCGCTTTTACTTTTGGTTAAGTTTCT
CTTCTACTATTTATTCTCTTAACAACATAAGTAAAAGCCTTAGAAGAGTA
AATTTTTAATTAGTAAAGGTTTAAGAATAATTAATTCAACCCCCCTTCTT
AATTATTATGAGGCCACTTGATCTAACACCTGTAACTCAATTAGGACGTC
ATTCAATAAGGAAGAGGAGGTATCTTGTTGCGGTGGTAGAGAGGGTGTGC
GTTCATCGAGAATGGGAGGTGGCAGGTCTTGTTTATGTTGGATCAAGTGG
TCTCGGAATAATTAAGAAGGGGGGGGTTGAATTAATTATTAGTGAACCT
TTACTAATTAAAAATCTATCCTTCTTAATATTACTAGATTCGATTAGGCT
TTTACTATAATGTTAAGAAAGTAAAGAACAAAAATAGAAACTTAACCAAA
AGTAAAAGTGATAATTAAAGTGCACAATGGAAATTAAAGAGTGCAGGGAA
GAAGAAGACAAACACAAGAATTTATACTGGTTCGGTAACAACCCGTGCCT
ACATCCAGTCCCCAAGCGACCTACGGTCCTTGAAATTTCTTTTCAACCTT
GTAAAATCCTTTACAAGCAAAGATCCACAAGGGATGTACCCTCCCTTGTT
CTCTTTGAACAACCAAGTGGATGTACCCTCCACTTGAACTGATCCACAGG
AGATGTACCCTCTCTTATTCTCAGTTACAACAACCCAAGTAGATGTACCC
TCTACTTGTACCACAAAGGATGTACCCTCCAATGTGTTAAGACAAAGTTC
TCAGGCGGTTAGTTCTTTGAAACTTTGTGAAGGGGAAACAAAAGATATCT
CAGGCGGTTAGTCCTTTGAATTCTTTTGTTTAAGGGAAAAGGAAGAATAA

FIGURE 26NN

AAAAAATTCTCAGACTATGTCGTTTTGAATTCTTTGACAAGGGAGAAGGG
AGACACAAAAGAATTCAGGCGGTTAGTCCTTCGTTCTTTTGGAAAAGGGA
GAAGAGAGACCCAAAAAGAATTCAGGCGGTTAGTCCTTGTCGAATTCTTT
TTGGCAAAGGGAGAAGAGAATAAAAGATATAGCACACTTCTATTTTCAAG
GTTTGGAAAAACCAGAAAACTTTAGAAAGCTTTTGGAAAGGAAGAAGAAG
AAGAAGAAGTTCAAGAAAATGTTCAAAGAAATTCAAAGGTTGTAAAAGAA
TATGTGGAAAAGTTGTTTGTAAAGGTTGTCAGTATTATTTCAAATGCAAA
TCAAGGTCTTGCTTTTATAGACTCTTGAAGTCTGGTCAGGAAAACCATTG
AAAGAGTATAACCTTTAGAAAAATCTGAAAACCATTGAAAGAGTTACATC
TTTTGATTTTTGTTCAAAACTTGTCACTGGTAATCGATTACCAAATCCTT
ATAATCGATTACACAAAGCATTTTATGAAAGGATGTGACTCTTCACAATT
GAATTTGAATTCCAACATTCAGATGCATTGGTAATCGATTACCAAAATCT
TGTAATCGATTGCACCATTCTGAAATCAATTGGAACGTTGCAAATTTAGT
TGAAAAATTTTGAAATCAAACTTTGCCACTGGTAATCGATTACAGGAAAT
TGGTAATCGATTACCAGAGAGTAAAAACTCTGGTAACTTAGAAAATTTGA
GAAAAATTCTTTTGAAAAACAAAACTGTGCTATGTTTGTTTTTTTGAAAA
ATCTTTTCAATACTTCCCTTGTGAAGTCTTCTTGATTTCTTCTCTTGAAT
CTTGAATTCATCTTCTCTTGAATCTTGAAATCAAACTTCTCTTGATTCTT
GAATTGTTGACTCAATCTTGAAATCATTCTCTTGGGCTTTTTGTCATCAT
CTTTTGTTATCATCAAAACATCTTGAATCAACTTGATTCATCATCATGAA
GCTTGCTTCTACAGTTTATACACCCATTGGCCATCCATATCCTTCTGGTA
TCCGAAGGAGGTAATAGCACCAACACCAATAGCAAAGGATCTTTTAACCT
TAACAAAAGGTTCATCCTCTAAAAGAACATTGAAATGCTGAAGAAACAAA
GTGACAAGATGAGGATATGGAAGAGGTGCATTGACTCGTAATGCCTTATG
CATTTGGTACCTAACAAGATGGGCCCAATCCATTTGGCGACCGATTTGAA
GAGCCCATAGCAAGATTAAATCCTCCTTAAAGGCTTGAGCAAGATTGGTG
AACCGGGGAAGCAAGACTCAAAAAAGGATATAATGCATGATGCGACACTC
AAAGGTGAATGAGCTAGCAAGCAATCTACCGGTCATATCAGTATGGTCAT
TACAGACCATTTTACGAGCATCATGACTAGAATAAACATGCTTCCAATCA
TCAACTAGAGTGCCTTCAAAAGGAACACCCTGACTGCTCAGTTTAGTCAG
AGAATAAAATAGAGATTGATCAACAACAATAGGTATTTGATGCACCTCAG
AAAAAATGACTTCATCCTGAATTTTAAGATTATTGTAAAAGACTCTAACT
AATTCAGGATAATATGGTAATTTTAGAGACATAAACTCAACTAATTCAGA
ATTTTGAAACACTTGATAGCAATCAAAGGTTTCCCCATCAAAGAATTCTA
CATCTAAATACTTAGGATCGAGAATGGCACAATTGGAGAATTGGGAATAG
TACCTTTGAAGTTGGTCATTGGAAGAAAATAGAGTCAATGACTTGGGAGA
TGAAAAAGAAGGGGGTTTTGGTGCTAGTGGGTCACCGGATGTGCCGTGGC
AGTGTTGGCCTGCAGTGGTGGTGGTGGAGGATGAGTCCTTTCTCTTCTTT
GCGGGTTTTGCAATTTGAGCTTTCTTAAGAAAATTATGATCAGTGGAGTT
TGTAGAGAATTCAAAAAGAAGAAATTTGAGCTTTGTTTGAAGTGATTTGG
ACAAGAAACGAGAAAGTTATGGTGATTTGAAGTTTTGAGAGGAAGGGGCG
CCGTCAAGGAGAGTGAGGGAGAAGAGGGTTGCACAAGGAGAGAGAAAAAT
GCAGTATTTATAGACAGGGACGAGCTGTAATTGATTATAGCCCATGATAA
TCAATTACAAGCGTAACCTATATCTGACCAAACCCTCTAGTAATCGATTA
CAGTCTATTGTAATTGATTATAGGGTCATGTTCTATGGTAATCAATTACA
GGGAGTGGTAATCGATTACCAGACCCTAAAAACATAGATTTTTCATTAAA
ACTAACTATTTTTCACTCAAAAAACTTACACACTCAGTATAACAATCATC
AACAACAATCAACAATCAAAATAATCAAAATAAGCATAAAAACTCTCAAA
CACATTCATCAAAGACAATCAAAATTTCAAAAATAATCATCAACAACAAA
TCAACAATCACCATAACTATTAAACATAATCATCAAAGACACTCAAAAAC
TCAAGCAAAAATAATCATTAAACCTTAATCAACAATAAATATCAAAAGCA
AACACAATCAGCAAGGACAATCAAAAGTTAACAACCCAAAAGAAAAAATA
ATAAACAAACAAATTAACTATTTATCTAAGTCATTGATATCTAGGAGTCC
TAATTCTCTTTTAATAACAAAGAATGTTTCTTTGGGGAGAGGTTTTGTAA
AGATATCAGCTAACTGATTCTTTGTGTCAACGAATTCTAGTACACAATCC
CCTTTTTGAACATGATCTCTCAAGAAATGATGCCTAATCTCAATATGCTT
GGTTCTCGAGTGCAGAATAGGATTTTTAGATAGGTTTATTGCACTCGTAC
TATCACATCAAATAGGAATATGATCAAGAATTAATCCATAGTCAGAAAGT
TGTTGTTTCATCCAAAGTATTTGTGCACAACGACTGCCAGAAGAAATATA
TTCCACGTCAGCAGTGGATAAAGCAACACTATTATGTTTTTTACTATGCC
ATGAAACTAGAGTAGAGCCAATGAAATGACAAGTTCCACTAGTGCTCTTT
CTATCAGTTTTGCATCTGACAAAGTCAGAATCAGAGTATCCTATTAGATT
ATAAGTAGAATTTTTAGGATACCATAACCCTAGATTAATAGTGCCTAATA
GATATCTCATGATTCTCTTAATTGCACTAAGGTGAGATTCTTTGGGATTT
GCTTGAAATCTTGCACACATACAAACACTAAACATTATATCAGGTCTACT
TGTAGATAAATAAAGAAGAGATCCGATCATACCTTTATATTTATTTATGT
CTATTGACTGACTGATTTCATCTATATCCAGATAGCAAGCAGTACTCATT
GGAGTAGTCATGTGTTTAGCATTTTCCATCCCAAATCAGTGAATCAGGTC
TTTGCAATATTTTGATTGACTAATAAATATTCCATTCTTTGTTTGCTTGA
TTTGTAGTCCAAGAAAAAAGTTTAACTCGCCCATCATTGACATTTCAAAT

FIGURE 26OO

TCATTTTGCATATCTTGCGAGAATTATTTGCAAAGAGAATCATTAGTTGA
CCCAAAAATGATATCATCAACATAGATCTGTACTAAGAGTATATAATTCA
ATTTTCTTTTAATAAAAAGGGTAGTATCAACCTTAGCTCTTGAAAAACCC
TTTTCTAAAAGGAATTTACTCAGACGTTCATACTAAGCCCTAGGGGCTTA
AACCATATAAAGCCTTTTTCAGTTTAAAGACATGATTAGGCTTTTCTGAG
TTTTCAAAGCCAGGAGGTTGATCCACATATACTTCTTCTTGGATAATACC
ATTTAAAAAGGCACTTTTCACATCCAAAGTTTGAAGTCCATTATGGATGC
AAAGGCTAATAACATTCTAATGACTTTTAATCTAGCTACTGGAGCATATG
TTTCCTCATAATCTATTCTTTCTTCTTGATTATATCCTTTGGCTACTAGC
CTAGCCTTATTTTTAATTATTATTCCATGTTCATCTAATTTGTTTATGAA
TAGCCATTTAGTTCCTATAACTGGATGATTATCAGGTTTCTCAACTAATT
CCCAAACTTTATTTCTTTCAAACTGATTTAACTCTTCTTGCATAGCTATG
ATCCAGTGTTCATCAATTATGGCTTCTTTTAAATTTTTAGGTTCAATCAA
AGAAACAAAAGCCATATTATTGCAAACATCTTTGAGAGAGTGTCTAGTTG
TTACCCCTTTAGATATGTCACCGATTATGTTGTCAAGCGGATGGTATCTA
GAAGTTCTTCACTCTCTTAGAAGATTTGTACTTGTTTTTGTTTCATCAAT
TTGAAATTTTTCATCATTTCCCTTTCCTTTTCCTTTGTGCTCTTCACCAT
GAATATGCATACCTTCTAAAGAATCTGAAAAATCATCTAGAGTATCCTTT
CTAGGCACAGTTGAGTTAGTTTCATCAAAAGCAACATGGATAGATTATCC
AATGATCATAGTTATTTTGTTATAAATTCTAAATGTTTTACTGTGCAAGG
AATAGCCAAGGAATATACCTTCATCAAATTTTGCATCAAACTTACCTAAG
TTCTCTTTGTCGTTGTTTAGCACAAAACATTTACATCCAAACACATGAAG
ATGAGAAATGTTCAATTTTCTTCTGTTATATAATTCATATGGAGTTTTCT
TTAAGATTGGTCTAATTAAAGCTCTATTCATTATATAGCATGCAGTATTT
ACAACTTCAGCCCAAAAATATTTAGGAAGGATTGCATCATTAAGCAAAGT
TCTGACTATTTCTTCTAAAGATCTATTTTTCCTCTCAACTACTCCATTTT
GTTAAGGGGTTCTAGGTGCAGAAAAATTGTGTCCAATGCCATTTTCATCA
CAAAATGATTCAAAATCCTTATTTTCAAATTATCCTCCATGATTACTCCT
AATAGATACAATTTTGAGATTTTTCTTATTTTGAATAATTTTAGCAAGTT
TCTTGAAAGCATGAAAAACACCTCTTTTATGAGTGAGAAATAATGTCCAT
GTAAATCTTGATTAATCATCAACTATAACAAGAGCATAGTAGTTTCCTCC
AAAACTCATAGTTCTAGAGGGGCCAAAAAGATCCATATGCAAAAGTTGTA
ATGGTTGAGTTGTAGACACAATATTCTTTGATTTGAAGGAAACCCTTACT
TGTTTTCCTTTTTCACAAGCGTCACATAATCTATCTTTTTCAAATTTAAG
TTTTGGTAAACCAATAACTAAATCCTTAGAAATTAGTTTATTTAAATGTT
CCATGTTTATATGGGCAATTCTTCTATGCCATAACCAAGGATTATCATCT
TTACTAAGAAAACATTGATCATGATTTAATGTTTTATTTAAATTTATCAT
GTAAACATTATTTAATCTATAGCCTATATGTTTTATATTTCTATCATGTT
TGTTTTCAACAACACAGTTATGAGATTCAAATGATACTAGATAGCCTTTA
TCACATAATTGATTAACACTTAGTAAACTGTGCTTAAGACCATCAACAAG
TATAACATTTTCAATGGAGGTAGATGAATTCATACCTATTTTTCCGACTC
CAAGGATTCTACCTTTATTGTTGTCGCCATAAGTCTCATGTCCACTATTC
TTGGGAGAAATATGAGTGAACTTTGATGCATCTCCCGTCATGTGTTTAGA
GCATCCACTATCTATGTACCAACTCTTCTTCAAAGAAACCTATATGATCA
TGTTTATGACTTAGGTACCCAAGCTTTCTTGGATCCTTGAATGTTAGTTT
TGATAAAAACATCCTTTTGGAACCCATATCATTTTAATATTATTATTATT
TTTCCTAAAATAGCATGTAGATGCACCATGTCCTTTCTTTCTACAGTAAA
AACAAGTTAAGAAAGGAGAACTATTCTTTTGATTGGATGCAAAGAATTTT
TTATATAACTTTTGTTGTTTATCAGGTCTATATCCTAATCTAGCCTCATC
AAACACACATCTTTGCTTTCCTAATATAATATCTAGATTATTTTTGCCAA
CAATAAATTTGGAAAGAGAATTTTTTAGATCCTTGATTTCTTCTATAAAC
TTGCTACAACAATTACATGCTTTTTTACTATCATTTATTACTTTTATGGT
GGAAGATTGATTTGTGCCAATTGGTTTTAAAGTTTTGACTTCAGTTCTAA
GATTTTCTAATTCTTCATTTAATTTTAAAACTTCCTTTTCTAATTTTGAA
ATAGTTTTCTTAGAAAATGAAACTAGTTTTGCAAGTTTGACTGATTTTTT
ATGTAAATCAATGAATGCATCTTGAAGTTCATCAAAGGAAATAGATAAGT
TATTGTTAGAAGATGTTACCTCTTCATCGCTTTCATAATTTTTTACCATC
AGACTTAGATTCACAACTTCATTTTTTGAGTCTTTGGATGAATCCATATC
GTTGTCTTCCCAAGTGATGTAAGCCTTCTTTGCTTTCTTATCATTGAAGG
TTTTCTTTTCAGATCTTTCTATTCTTTTCTTGAAACTTGGGAAATCA
ACTCTCAGATGTCCTCGTTGATTACATTCATAACACTTTGGAAGAGAGGG
TGAATCTTCTCCTCTTTTTTTTTGGTTTGAAATTTGATCTTTTTTTATTT
CCTTTGTTTCTTAAAAATTTATTGAACCTCTTTACGAAGAAACTAAAATC
CTCATCTTCCTCTATTTCATTCAAATCTTCTTTATCACCTCCTTCTTGAA
TTGAAGATGAAGCTTTAAGTGCAATTCCTTTCTTTTTCTTGCCATTTTCC
TCATGTTGATTTAGTCTCATGAGTTCCATTTCGTGTTCCTGAAGTTTTCC
AAACAAAGTTGCAAGAGACATGTTAATAAGATCTCTTGATTCTGTAATAG
CCATTACCTTTGGTTGCCATTTCCTGCTTAAACATCTTAGAACTTTGTTA
ATAAGATCCTTATTGGGAAATATCTTTCCTAATGATGCAAGATGATTTAC
TATGTGTGTGAATCTCTTTTACATATCCTGTATAGTTTCATTTTGATTCA

FIGURE 26PP

TTCTAAACAATTCATATTCATGGGTTAGGGTATTTATTCTAGACCTTTTT
ACATATGTTGTTCCCTTCATGGGTTACTTGTAAGGTATCCCACATTTCTT
TCGCATTCTTGAAGTTTGATACTCTAAAATATTCATCCAATGCCCTAATG
CAGATGTAATTATATTTTTGGCTTTTAAATTATATTGTACCATTTTTCTT
TCCTATTCATCCCATTGTTCCCTAGGTTTTTCTATAGTTGCATTTCCTGC
TACCATAGTAGGGATGTAAGGACTAATTTCTATGGCTTCCCAGATGTTTA
AATCTATAGCCTCTATGAAAATTTGCATTCGGGTTTTCCAGTAATGATAA
CCCACAACATTGAATATAGGAGGCCTATTTATAGAGTTCTCTTCGGGAAA
TAAAAAATTTGATGAGGCCATAACTATTCTTGAAGTTTCTAAACCTTATA
CAAGAATTAAGCTCTGATACCACTTGTTACACAAGTAAACTCAATAACTT
AAGAGGGGGGGGGGGGGGGTGAATTAAGTTTAAAAAATTTCTCCTAACAA
GTTTTAATTCTCTCTTTAAAAGAAATATGTAGACTTAATATGCAGAAAAA
AGAAGTAATAAACAATTTACTTGATGCTTCTTTGAATATGCAAAGTAAAT
ATAAATTGCAATAAAGTAAAAGAGTTTAGGGAAGAGAGAATTGCAAACTC
AGTTTTATACTGGTTCGGCCATGTCCTGTGCCTACGTCCAGTCCTCAAGT
AATTCACTTGAGATTTCCACTATACTTGTAAATTCCTTTACAACTTCTGA
ACCACCTTGGGATATCCTTCCCTTGTGTTCAGAGAACTTACAAATCAAGA
GACCCACTACCTCTTGATTACAACAACAGATTGCTTTTGAAGTACATAAG
ATGTTTTTCTCTCTTTAAGAGAAGAATGATACAACTTGAAGAACTTATAA
GAATCCTTAATGATTTTGCAAGTGTTTGGCTAAAGGTTTTCTTGTGAGAG
GATAGGACAATGAATGTTTTGAAAAACTCTGAAGAATTTCGAACACAAGT
CACATATTTATAGGCCTTTGGTGACCTTTCAAAAAAATTTATGAAGAGTT
GTGAATTTTTAGAGTTATTTCTGAAATTTCCTCACTGGTAATCGATTACA
GATATGTGGTAATCGATTACACAGTTAATTTTGTGGAGTCATGACTTTTC
AGTTTGAATTTCAAAACCTTTTGTGACTGGTAATCGATTACACAATAGTG
ATAATCGATTATAGATTTTAAAATTCAAATTTAAACTTTTCTGAAAGTTG
TTTAAAAAACATTTTTTCTTTTGGTAATCGATTACAGCCTCTAGTAATCG
GTTACCAGAGAGAAATACATAATTTTCAAGATGTAATATTTACTTAAAAA
CTTTATAAGATATTTGAAAGCTTTTGTTAGATGTCTCTAATGACTCATCA
GGATTTTCAAGTTTATGCCATTATTGTAAACCACAGTTACAATGCTAAAT
AAAATGAATAAATTTGACATCTTTGTCCCTCATCCTCTCGTAATTACATC
TTTGCTTCCACTGGAATGTGGGTGCAAGCCATTGGTTTGTTTGCTCAAGC
GACATGCACTCCTGAGTTTGGACTTCCAAGACCGTTCAATTAGAAATTAC
TCGTGCTACACATTTGGTGAGGATGCCGTAAACAACGAGTAAAGTAGAAA
AGGAAAAAAGAAAAGGAAAAAAGCATTTGATTGACTGTGTTTTCAAGTAA
AATATAGACATTCATGTGACTCATTTTATCATTCCGGAAAGTTTGTCTTT
TTTAGAGATAAGTGAGTTATCAAGAATAGGAGTCATTTGACTTAATCCGT
CAACTGAAAAATCCTTTGACTATTTCTTGTCCTTGGAAAATTCTTTTTGC
AAGAATCAACTGCTTCTTTCATTCTTCCTTGCTACAAGGTTGTGGAAACA
AAACAATGATGGTTACCTCAAAGCCCTACACTGGGGCAATGATGGTTACG
AAGTCCGCATTTCAAGACAAAGGTTGCATGCATCTGCATCCCTAAAAATC
ATGTTAACTACATAGATTTCCAACATCTAATGTCCCAACTTTTAATTTGG
GATGAAAGGCTCTCTCGATGAGTCAATCTTTTGCTTTCTCATAGGGGTGG
ACCCTTCGGTACTAGAACCTATTGCCTTTAGCGGACTACACGTCCTCGCC
TTCAGAGGGCTACACGCCCTCACTTTCAGAGGGCTACACGCCCTCGCCTT
CAGAGGACTACAAGTCCTCGCCTTCAGAGGACTACACGTCCTTGCCTTCA
GAGGACTACACATCCTCGTCTTGAGAGGGTTGCACGCCCTCGCCATGAGA
GGACTGCAAGTCCTCACCTTCAGAGGGTTGCACGTCCTCGCCTTCAGAGG
ACTACATGTCCTTACCTTTAAAGGGCTACATGCCCTCGCCTTGAGAGGGC
TACATGCCCTTGCCTTGAGAGGACTACACGTCCTCACCTTGAGAGGGCTA
CCCGTCCTCGCCTTCAGAGGACTGCACGCCCTCGCCTTCAGAGGACTGCA
CGTCCTCGCCTTCAGAGGACTGCACGTCCTCGCCTTCAGAGGACTGCACG
TCCTCGCCTTCAGAGGACTGCACGCCCTCGCCTTCAGAGGACTGCACGCC
CTCGCCTTCAGAGGACTGCACGTCCTCGCCTTCAGAGGACTACACATCCT
CGCCTTGAGAGGGCTGCAAGTCCTCTCCTTCATAGGGCTTCACGCCTTCG
CCTTCAGAGGACTGCATGTCCTCGCCTTCAGAGGGCTGCACACCCTCGCC
TTCAGAGGACTACACGTCCTCGCCTTTAGAGGGCTGCACGCCCTCGCCTT
CAGAGGACTACACATCCTCGCCTTGAGAGGGTTGCATGCCCTCGCCATGA
GAGGACTGCAAGTCCTCCACCTTTAGAGGGTTGCACGCCCTCGCCTTCAG
AGGACTACATGTCCTTACCTTTAGAGGGCTACATGCCCTCGCCTTGAGAG
GGCTACATGTCCTCGCCTTGAGAGGACTACACGTCCTCGCCTTGAGAGGG
CTGCACGCCCTCGCCTTTAGAGGGCTGCAAGTCCTCGCCTTCAGAGGGCT
TCACGCCCCTCGCCTTCAGAGGACTACACGTCCTCGCCTTCAGAGGGCTG
CACGCCCTCGCCTTCAGAGAACTACACGTCCTCGCCTTTAGAGGGCTGAA
CGCCCTCGCCTTCAGAGGACTACACATCCTCACCTTCAGAGGGTTGCACG
CCCTCGCCTTCAAAGGACTACGTGTCCATACCTTTAGAAGGCTACATGCC
CTCGCCTTGAGAGGACTACATGTCCTCGCCTTCAGAGGATAGCACGTCCT
CGCCTTCAGAGGACTGCACGTCCTCGTCTTTAGAGTGCTACACGCCCTCG
CCTTTAGAGGACTACGCGTCCTCGCCTTGAGAAGGCTGCACGCCCTCGCC
TTGAGAGGGCTACAAGTCCTCGCCTTTAGAGGGCTTCACGCCCTCGCCTT

FIGURE 26QQ

CAGAGGACTACACGTCCTCGCCTTCAGAGGACTGCACGCCCTCGCCTTCA
GAGGACTGCACGTCCTCGCCTTCAGAGGACTGCACGCCCTCGCCTTCAGA
GGACTACACGCCCTCGCCTTCAGAGGGCTGCACGCCCTTGCCTTCAAAGG
GACTACATGTCCTTACCTTTCAGAGGACTACATGTCCTCGCCTTCACAGG
ACTACACGTCCTCGCCTTCACAGGACTACATGTCCTTGCCTTCAGAGGAC
TGCACGTCCTCGTCTTTAGAGGGCTACACGCCCTCGCCTTCAGAGGACTA
CACGCCCTCGTCTTCAGAGGGCTACATGCCTTCACCTAGAGAGGACTACA
CATCCTCGCCTTCAGAGTACTACACATCCTCGCCTTCAAAGGGCTGCACG
CCCTCGCCTTTAGAGGGCGATGTGTCCTCACTTTCAGTGGGCTCCACATC
CGCACCTTTAGAGAATTTAAGGTCCTCTGCCCTTAATGCTTAACCGAGAC
TTGCGCTCCCGGTTAAGGGGCCAGTAGTTTCCTTTTATCAGCTCCTGGGC
CACCCCTTGATCCTGGAGGAGGGCCAACTATGCGAGCACAACCAGAGGAG
GAGGCTATCGCGCAGCTACTGTGCATACCGGGGCAAGATTTCTCCCGTGC
CACTGCAAAGAGACGAGTGCAGATCATGCGCACCAACATGACCACTCTTA
CACAGATATGAATGACGTTGCTACTTAGCAACATTCTGCCCAGTGACCAC
AATGTCGAACTCCCCCTATGGAAGTATCAGTTGGGATCGCACCCACAAGA
CACCCAGTGGACCCGAAGGAGTCCAACAGGGCCCTGGGGTTTTCAGCTCT
GGTTACGGGCCTCTGCCAGTCCTACAGGGTACCCGTCCCCCCCAGCAAGC
TCATGCCATCGTAACATAGGTAAGTATGCACGTGGTTCAACTGATTTCTG
ATGCCATCCCCTATTTGCAGGGATCGTGCCCACAAGACACCCAATGGACC
CGAAGGAGTCCAACAGGGCCCTGGGGTTTCCAGCTTTGGTTACGGGCCTC
TGTCAGTCCTACAGGGTGTCCGTCCCCCCCAGTAAGGTCACCCCATCGTG
ACATAGGTAACTATGCACATCTCTCAATTGATTTCTGATGTCATCCAATA
TTTGCAGGGATCGCGCCTGCAAGACACCAGTGGACCCGGAGAAGTCCAAC
AGGGTCCTGAGGTTTCCAGCTCTGATTATGGGCCTTTGTCAATTCTACGG
AGTGCCCGTCGCCCCCAACAAGGTCATCAGGCCCCATATTAACCAAGCTT
TCATCAAGAAGTATTGCGCCCCCAGGCAGGCGCAGGGCGAGACACCACAG
CAGCCTAGGGATGGACGGCAGCGGGCAATAGATACACCGCCACCACCTCC
AGAGCCCCTCAACTCATCTACAAAGGCTGGAGCGTTGCCTACGACCCATG
ACCGACCAGCAGGCGACCAATTCCAAAGCCAAAGGTAAGCAAAAGTACTA
GGTCTGTGATCGACAAGTCATCACACGTCCAGCTCAAGACGTTAAAGAAG
CGCTACTAGGAGGCAACCTAGTACTTTTTAAATCTCTGCTTGTTATTTGA
TCACCTTTGTTTCTCAAGTCATAGTAGGACACACCTAGTTGCTCATGATC
CTAGGAATTTAAATAAAACAAGCACAAGCTCGGAAGGTAGTCATACCTCA
CAAAATATATGTATGTGTGTTTAGGTAGCGAAAATACCTTAGATATACAT
GTATGTAATTTAGGTAGCAAAAAAATACCTCACAATATATATATATATCT
ATGTTTAGGTAGCAAGATACCTTGGATATGCATGTATATAGCAAAAATAC
CTCACAAAATATATATATATGTATGTTTAGGTAGCAAGATACCTTGGATA
CATATGTATATAGCAAAAATACCTCACAAAAATATACATATGTTTAGGTA
GCAAAATACCTCATGAAAAAACAAACAAAAACAAAAAAACAAAATAATAA
TAATAATTGGTTAACTAAAAAGCCAACATGCTTTTGAAAAGAAATAGTCT
CCAGCTTTTCTTTGGAAAGAGTCACCAATCAAAACACAAGGTTTTTGAG
GAAAATGTGTCTACACCTGAAGGGTGAATGCTGTGAAATTTTTCTGAACG
CCCAAAATGGACTCGAATGGATGCATGAATTGATAAAAAAAACATGTTTT
GGAAACACTAGGTTGACTTAAATAGGGAAAATGAATCCTGGGCCCTAGTG
TCACATGACCATAAAAACTTGATACTTGAGTGTCCACATGGGTGCATATA
TGACCAGTTTTGCATAAAATTTCTAAATCATCATTGTTGCATGTGTGTCA
TGGAAATAATGTGAGACATTCCTTTATCCCTGAACCGCTGGCCAAACCAA
CACCCTGACATACATCATGTCCGGCCGTTCTACAAGCCTTTTGACCCAAG
ACCTCAAACCACCATAAACCTTGACCCAGGATGAGAATTTCCATCCCTGT
CCTCAGAAGAAGGAGCAATAGGGTCTCCCAAGAAAAAAAGTCATTCACTA
TTGAGTTGCTAACATGCTTCCATAACAAAGAAAGTTCCCGATCAAAGATC
GAAAGAAAACAAAAGAAAAAAAGAAATTCCTGATCAAAGATTGTGAGAAA
ACAAAGAGAAAAAAAAAGGAGAAAATCTCCGATCAAAGACAATGAAAGAA
TTATACAGAAGTGTCTTCGGACAAGACAAATATCCAAACAATACGGAATA
GTCACAGCCAAATAAGGAAAGAAAGGAAACCACGACTTGAAGTGGTCCTC
TCCGTTTGATTGCCAACCAAAATCCTGTGCGTCGGTGACTTTTTCGCCCC
GCACTAAACAAAAACAGAAAAGGAAAAGGCCAAAACACTCAGAGCCAAAT
TTCCCACAAAAAAAAAAACACCATTCCCGAAAAAGTCCTATTGATCTGTG
ATCACACATGTAATCTTTGATTTGATAGGAAATGATTTGCAAAATCAAGT
CATGACATATCTATGGTTCTGAATTAGGATGAAACACTTACCTGTGTGAG
ATTGATACACTTTGAGTGATTTTCTTCTATTTTTGTTGGACCCAGTGTTT
CCTCTAAATGGTCGTTTAGAAACAAAATGCTAACATCCAAAATCTCATTT
ATGGTTATGAGAAAATTTCATTAGCATACTCTCCTTCCCCATTAGACACA
TTGTTTTTCATCAAAAATCATATGTTGCTCTGATCAGTTGGAGGTTTTGT
TTCTTTACTAAAGCCTGTTTGCATTTTAGTGAAAAAACACCGAGACTATT
TTAGTATCACAAAAGCAAGAACTATGTTGGTCTGAATTCCTCATCGTGAT
TGAGGATACGTAGGAGCAAAAGCCTCGCTTTTGTCGACCGCCCAACCTTT
TGCTATCGTGACCTGTGAGTCCGTTGGTGCGCGGAGATGCCCTATACGGT
AACCCGCACACATTCATTTGCTATCCGTCAGACTCAGAGTCCGGTAGCAT

FIGURE 26RR

GCAGAGACTAACATCTTCTTCTGCACCTTTTGTCAACCAGGGGCAACCGA
GCCCGTTGACACGTAGAGACTAACGTCGTCTTCTGCACCTTTTGTCATCG
AGAGACGGCGAGTCTGGTGACATGCGAAGATACCCAAGCGGTTATTCGTA
CAAACGATTTCTGTTAACCCTGACCCGGGAAGTCAGGTGGCAGGCGGGGG
TACTGTATGGTTATCCGCACCTTTCGTCAACCAGGGGCGAATGAGTCTGT
TGACGCGCAGAGACTAACGTCATCTTCTGCACCTTTTGTCATCCAGAGAC
GGCGAGTCCGGTGACATGTGGAGATACCCAAGCGATTATCCGTATGGTTA
TCAGCACCTGTCGTCAACCAGGGGCAAACGAGCCCGTTGACGCGCAGAGA
CTAACGTCGTCTTCTGCACCTTTTGTCAACCAGAGATAGCGAGTCCAATG
ACATGCGAGGGTATCGTATGGTTATCCGCACCTTTTTTCATCCAGAGACG
GCTAGTCTGATGACATGCGGGGGTACCGTATGGTTATCCGCACCTTTTGT
CATCCACAGACGGCAAGTCCGATGACACGCAGGGGTACCGTATGGTTATC
TACACCTTTCGTCAACCAGGGGCAAACGAGCCCATTGACGCGCAGAGACT
AACGTCGTCTTTTGCACCTTTCGTCAGCCAGGGGGGAGGCGAGCCCCGTT
GATGCGCAGAGACTAACGTCGTCTTCTGCACCTTTTATCATCCAGAGATG
GTGAGTCCGATGACATGCGGGGGTACCGTATGGTTATCCGCACCTTTTGT
CATCCAGAGACAGCGAGTCCGATAACATGCGGGGGTACTGTATGGTTATC
CACACCTTTTGTCATCCATTGATGGCGAGTCCGATGACATGCGGAGGTAC
CGTATGGTTATCCGCACCTTTTGTCAACCAGGGGCAAACGAGTCCGTTGA
CGCACAGAGACTAACGTTGTGTTCCGTACCTTTCGTCAACCAGGGGCAAG
CGAGCCCGTTGACACGCAGAGACTAACGTCGTCTTCTGTACCTTTTGTCA
ACCAGAGGCAAGCGAGCCCGTTGACACGCATAGACTAACATCGTCTTCTG
CACTTTTTGTCATCCAGAGACAGCGAGTCCGATGACATGCGGGGGTACCT
TATGGTTATCCGCACCTTTCGTCCACCAAGGCGAACGAGTTCGATGGTAT
CGGGATGATGTTGGTTGTCCGATTCTGATTATTTTTTGAAATTTTTGCAG
GTTTTTACTTTTGTCATCCAAAGACGGCGAATCCGATGACATGCGGGGGT
ACCTTATGGTTATCCGCACCTTTCGTCAACCAAGGTGAACGAGTTCGATG
GTATCGGGATGATGTGGTCGTCCGGTTCTGATTATTTTTGAAAATTTTTG
CAGGTTTTACTTTCGTCATCCAGAGACATTCAAGTCCGACGACGCGCAAG
ATTCTTCACTGCTAGGCAGGGACGATCGAGTTCGATAGCATGTGGAAACG
TCATGGTTATCCTGTTTTATCGCTTTCAAGACACTGAAGTTTTGCTAACG
CTTCTGGTGCCTTTTCTTTTCTTTCTAAATGACAGGTTCCGCTGGTTGGG
ATATTGATCGGCCGAATGATGTTCTGCTCGAACGAAATTAGTGTCTTATC
TTTACTTCGCTTTTATCTCCAATAAAAGATAAGTAAAGAGGGGCAACTGT
CATACCCTAATTTCGTCCAGGGACCATTATTTGTTGGCATGCGACCTTCT
CTTGACCGCCTCAAAATGTTTAACACCCATCGTTGTGTAATCCGTAAAGT
CTCGCAACATTTTGGAAGTCAAAACAAGTATTGTTGCACAATCCGTAAAG
TTTTGCAACATTCTGGAAGTCAAAACAAGTATTGCTGTGCAATCCGTAAA
GTTCCGCAACATTCCGGAAGGAAAAAAACAAGCATCATTGCGTAATCCGT
AAGGTTTCGCAACATTCCAAAATGAAAATGGGTGTTGTTACGTAATCCGT
AAAGTTCCGTAACGTTTCGGAAAGGAATCAATAAAAAAACACAAAAGGGA
GTGTGTTTAGTGAAAAAGGGGGTGCAAATAGCAACCATGCCCACTTGGGC
CTTCCTGAGAGTTCCAAAAGAAGGTGGTGCCTTCTAGTGGAAACAACCCC
TGCTCGCCTGGGTGAGCTGGGCGGCAACCACCTCCCTTTTTTCTCCTATA
AATTGGGGAAAGAGGGCAAAACAAAAGGTTCAGCCCTTCTAGTATTTGAG
AATTCTCTCGAAATTAGTGAGAAAAATTGTTCCATGAAAAAAATCCAAGC
CGAGGTGCTTCCGTAACACTTCCGAGACGTTTCCGTAGGCGATTTCGTGG
AGATTCTTCACCGTTCTTCATCGTTCTTCGTTCGTTCTTCATCGTTCTTC
GGTCTTCATTCGATAAGTTCCCGAAATTGAATCTCTCAATTCATTCTATG
CACCCTTAGTGGTCCCTACTTGTTTCGCGTACTTTTATTTTCATTTCGTT
TGTTTTCCGTACCCCCTTTTATCGTGCTTTAACCGTTTATTTAATCCGTT
TTCTCACATAGTAAATGATAAAATAAATTTCAACCGATCATTTGAGTTGT
AATCTCGATTAATCACCATTAAAGTAAAATCTAATCAATCGTTCACACTG
TAACCACGGTTAGACAAAAAAAGGGAAAAATAATAATAAAATAATCAAAA
TATCTTTGAATAAAATAATCAAAAAAATCAATCGGATGTTTTTCTTTGGA
AGTTTCCTTGAATGAATTGACTAATAATCAAAGTGAAATTAAGGCTAAAA
TCAACTCACAAATCAAGCTTCGTCCGCAAAAGTCACTCAAAACCGTTTTA
AGGTCCAACGCCTTAAACGATCATCTTTGCTTTTATCGGTTAACATGGAC
CGTTCTAAAGCATAAAATCAACACATAACTTTACCGCTTTTGCAAGAACT
ACGTAGGTCTGATTTCCTCATCGCAATTGAGGATACGTAGGAGCAAAAGC
CCCGCTTTTGTTGACCACCCCAAGAGATCGTTAATGGTCCAACGTCTTAA
CGTTTCTCTCCTTTCAAAACCAAGAGATCGTTAATGGTTCAACGCCTTAA
CGTTTCTCTCCTTTCAAAAACCAAGAGATCGTTAATGGTCCAATGCCTTA
ACGTTTCTCTCCTTTCAAAATCAAAAGATCGTTTAATGGTCCAACGCCTT
AAATGACCTTTTGTTCGGTTAAAATATATCTTGCGAAAAAAGATAAAAAC
AACTTAACCAACGTTTAGTTCTAAAGAACTACGTAGGTCTGATTTCCTCA
TCGCAATTGAGGATACGTAGGAGCGAGGGAAACACCCTTGTCGACCACAA
AAAGATAAAAAAAATACAAAAAGCATAAAAAAGACATAAAAACATAAAAA
GGGAAAATAAAACAAATCGAAGACATGATATTGCACACTTGGTTAAAGGT
TGTCGTCCCTTGTGACGGACGCGTGGGGTGCTAATACCTTCCCCGTGCAT

FIGURE 26SS

AAAAACAACTCTCGAACCTTTCACGATTAAAGTTCGTAGACCACACCTTT
TTCGGTTTTTCCGATGTTTTCCTCAAATAAATGTTGGTGGCAACTCCGTG
CATTTTCCTTTCTTGAAAAACGCACCTGTGAGCCCCGCGTCGCCCTCCCG
CCGAAGGGTAGGTTGCGACACTACCCATGTGCAAATGAAACATGTTTTCA
TTGTGTAATTTTTTATGCTTTCTAACAAAACAAAAACACATTTTTGTTGT
ATGTCTAGACCAAAGAAAACACATTTCCATTGTGTAACTATCCATGTGCA
ACGAAAACATGTTTTTGTTATGCAATTAGGGGGAAAAATACACAAAGAAA
GTGTACTTTTGTTGTACATTTTTTTCACCCCAATTGCACAATGGAAGCAC
GTTTCTATTATGTAATTTTTAAGGGGACAGTTTTGAAATATGGACAAAAA
GCACCCCTCACGGTTAGTGCCATTAGAAAAAGTAGGTGGTGCCTATAGTA
GTTCGCTAATATTGGATATGCACTTCTTTTATCAGAAGGGCCCAAATAGT
CCATCAAATAGTAGAAGTTTTTGCCAATGTCGGAACGTGAACAAACATAC
TAACAAACATGTGCTTGATTAAAAATAAAAAATAAAAGAAAAAAGATTTT
GGATGAGTATGAATAATGAATCAAGTGGTGGGGTGTGGCCACCACTAATT
GCATTTTGGCAAAACAGAATTCACATCTTGACAGCAAAGTTGATTGATTC
ACTGTCCATGGATCATTCGAAGCAAGTGGTTGTTTGCGGCGATGGAGTCA
TCGAAGTCTGCACCGCCTACTTTCTGGCGGTGAAGGGTGTCTATATCATG
CTCATTGAGAAATTCAACGTGGCATGCACTGCATTCGAAAAAGCTGGCAG
ATTCCTTGCCCTCAATTGGTGCAATAGAGGACCGCTAGAAGAGCTAGCTC
ACATGAGCTTCAACCTCCACCGTTCACTCTTCGAAGAACTAGACGGTTCA
TGATCGTACAGTTACAGAACCCTCACCACTCTCAGCCTCATCGTTACGGA
ATTTGAAGGCTCCTTTTCTGCCACCTCAATGTTGTCGTCTTGAGTTGACA
GACCTACTCGTGGTTGGAACCATCGAAATGACAGTGCAGGTGCACCTATG
GCTCTTCATTCCCGCGCTGATTGATAGATCAGTGGAGAAGCATGGAGTGA
AGATAGAGATTACAAAATAGGAACGGTTGGAAGTGGAAGAAGGATGAGTT
GGATCGATGGTGCTTGAAGAAGGACGAGTTTTGGAAGCGGATTCTATGGT
GTTAACATTGGGCCCTTAGTCCAGTAAGTTGGTTTTGTTGTTCATAGTTT
ATGGGCTTATGGGCTTAAGGCCCATAGCATTGTATTAGAGGCCAGAGAGC
CCGGTTCTATAACCCTGCATGCCCTCTTTCTCAGTTACTATTCTTCTAAA
CGAGGAAAATCTCTTGACCCCGAAGTGTACCCTCCCCACACAGGTATGTT
AATTTTATTTTTTTACAGAACATCTACCGACTTTACCAATCATTAATTTT
TATTAGAGAATTTAACTGGTCACTTTTAATGAGTTCTTCCCTTCCAAACA
GAATCTAGTATCATTCGGACAAACGCAACTTGTTGATTCCCAGGTGTAGT
AATTAGTCACACTTAGTAATAATAATATTAATAAAGAGGTTAATAATGTA
AACATTTATTTTCAGGGGAGGTTTATATATGTGGGATGTCGAAGGAGAAA
GAAGTTTCGGATAATCGTGAGGAGATAAAGGGAAACCCTGAATTAATTGT
GATGCTTAAAAAGGTGGTGAAGACTGTTTCAAGCCATCTTAGGGAAGGAG
TGGCATGTGTGAAGGGAGAGTAATAGGAGAGGTTCCAGGGGTGAAGGGGT
GTTATGTTGCAACAGGGCATAATTGGGATAATATTCTTAATGGTCCTGCC
ACTGGAGTTGTTGCTGAGCTTGTTATTGATGGACATTCCAACATTGTTAA
TCTTAAGCGCTTTAGTCCCACCAGATTCCTGGGGCGTAGAAAGGCTTAGA
CAATAAAGACTACGAGTGTTAGTTTAATAACTTTGTGTCATACCCTAATT
TCGTTCTAAGACTATCATTTGTTGATCTTTTGATCCTCGCTAGCCGAATT
AAGCTGTATGACACCAGTTACCGTGCAAGATGAAAGATCATTTGATGTTT
CCATAAGGAATACAGAAAATCCCCAAAAAAGAGGGCAACAGGGTCATTTT
AAGCCTTTTTCTGAACCCAGGCTAGCCCCTGGCTCGCTTAGGCCCCAAAA
TAGCTTAGGGGTGAAATAACTAGCTCGCCTGGGCAAGCAAAGTTACTTCA
GGTTGAAGCTATAACTCGCCTGGGTGAGCTGCCATGACTCCTAATGCCAT
CTTTTGCTATAAATAGGTGTGAGGGAGGCTGAGTAAAGGGTTCCAAGGTC
CAACATTGAGAGAAATCAGAGAGAAGAAGAAGAAAGAAGAGAAAAACGAG
GCCGAGGTGCTACCGAATTGCGGATCCTAATCGACTTCTACATTGTTCTT
CGTTTGTTATTCGTTTGTCATCCGGTTAGTTTTTGTTTTAAGGATTTGAA
TGCGATCTACGCACCCTTACGAGTCCTCTTTCTTGTTTTGTGCATCTTCA
TCTCCTTCTTTTATCATCAATAATCTCATCTTCATCCTCTTTCTTGTTTT
GTGCACCCTTACAAGTTATCTTTAAAAAAGATTGAAGGTTAATAAGCAAA
ACCAAAATAAAACCAACTCATAAACTTCTTCATTTAATCAAATATCGCTT
GAGATCGTTTCAAGGTCCAATGCCTTAACGATTCTCTCTGCTTTTCATCA
AACATCACTTGAGGTCGTTTCAAGGTCCAACGCCTTAACCATTCTCTCCG
CTTTTCAAATTTTTAAAACATCGTTTCAAGGTCCAATGCCTTAAACGACT
TTTGTTCGCAATTAAAATCGATCTTTTAAAAAGCATAAAATTAATGTAAC
ACACAAACTTTCAGACTTAAAGAACTATGTAGGTTTAAATTCCTCATCGC
ACCTGAGGATACGTAGAAGCAAGGGCAACACCCTTGTCGACCCCAAAAAA
TAAAAAATATAAAAAGGGAAAATACATAATTTTGAAGTCACATTTTTGCA
CATTCGATTAAAGGCTGCCGTCCCTTGTGACGGATGCGTGGGGTGCTAAT
ACCTTCCTCGTGCGTAAACAACTCCCGAACCCATATTTTCAAAATCCGTA
TACCTCTTTTTGGTTTTTTCTAACGTTTTCCTCGAATAAATGTTGGTGGC
GACTTCACGTGTTTTCTTCATGAGAAGACGCACCTTTGGCTTTTCGCCTC
GCCCTTTCGCCAAAGGGTTGGTTGTGACAGTTGGCAATTCCACTGGGGAC
TGTTAGAGAGTTAGGTCATTCAGCCAGTGTGCAATGTTTTTATCGTGACT
TCTTCTTTATTTATGTTCCCTTTTCCCTTTTATCTTTTGTTTTGTCCATA

FIGURE 26TT

TTTGTATATAATCTTTGCTATGTTGTTGTGTTTGGTGTGTGTTTGTCTAT
CAATTACATTCATAGTTAGAAATATTTTTTTCTACGCACACATGGCACCT
ACGCCTCGCACACACGTTGAGATATTAGGCCCTATACCCGGGTCTATGTG
AGCCATAAGGAGTGGAGGTCAATCTGTGTTCATGCTGGGTCTCTGACTCG
CTTGGTAACAGTGAAGCCTTATCTAGAGTTTTCCTCTTTTGGTGATGCAT
TGTCGCTGATAGTCCCTATCGCCACAATGTATTATCTAACAGGATGATAT
CTCTAGAGACCGGTAAAGTTACATGAAACCATCCTTGGAAGTTGTGACTA
GAAGGGGACCTTTTGGATCCTTTCCATTAGGTTCCTAAATTAGGGTGGCA
CATAGAAAACTCACTCTGGCTTGTTCTTTGATCGCATCATGCATCTCTTC
ATGGCATCATAATGTACATATCATTCTTGCATTTATCATTTGTCATATCC
ATGCATTGCATTTGCATAAGTTGTTGCATTGTCATGCATTTTCATTTAGC
ATGCTTTTGTTCTGCCAACTGCATACATTCTATTTTCATAGTTTGCATGC
ATGATCCTTGCATTTTCCTCTGCAAAAAAAAAAAAATTAAAAATAAAGAA
AGAAAGAACAAAAGAAAGTCACCATAAAGTGTGAAAGTTTACACCACATT
CTTAGTTACATGTGTTGGGTACTATGATGATAGCTATAAACCAACCATGT
TGGGATTATGCACTCATTTCTCTTAAAAAATTATTGAAAATCATGTGAAC
ATGGTACCTAATGCATGGTTAACTTGGAAATGATGTTTCTTCAAGCATCT
CATGTCAACCTCATAATTACATGTGTCATGCATAGCATAAGTATGCCCAA
GTCATTCATCTCTATGATATGTTGTTGAAGTATTGACAGTCAAAATTTCT
ATTCCTTGGATTATGGGGTCGAACCAAGCACATGCTTTTAAGAAAAAGGT
TTCATCAAGTCAAAGTCAAGTATGGAAATAACTAGCTGCAAAAGTTGGGG
CAGAAGATGGATCAAGTTTACATAGCTTCTTTGTCTACTGCCAACACATG
GTTGAGCTAAATAATTAACAAAAATTAGGGATTGTTGATGTCCATGCGTT
ATTTCCTATTGCATTTTGACAAAATGTAATGAACAATGTTGTTTTAATGA
AAATCTAAATTGGTTCGACCCTATTGAGTGCCCTATGTAAATTTGCAATA
CTTCAACAATGTATTTGTTCACATACATCCATGCTTATTTTTTCTTTTCA
CGTTGGTTGCATTGCTCATTTCATTATTTCCTTGAAATCAGAAACTGTAA
TCATTGTAATCAAAAGGAAAGAATGCACTTTTATGGCGCCCTTACCGAAC
GCGTGCATGAGCTAGAATAATGAGTGAAATAGAAGAAGTGCAAGAACAGA
TGAAGGCCGACATGGAGGCCATGAAAGACCAAATGGCCGCCATGATGGAG
GCCATGTTGAGCATGAAGAAAATAATGGAAAGCAATGCGGTTGCAGTTGC
CACTACGAGTGTCACCACTGAGGTAGACCTGACTTACTTATCGAGCCTCA
ATCAAGTAAATCCTCCAGTCACCATTTTGTGCAAGTTTAGAGCAAGCATT
CATTCCCTGGCTTGCCTCCCAACTACGCACCACCCAATGTTGCACACACT
CACGATGAGAATGTCGACAACTTCATGCCCCCATACCCATTAGAGCCAAA
AACCCCAATCTGATCATGCACATGTCTCTCAACCCATGGAGGAGACACAT
GAAGCACCCCGAGACCATAATATAATCGACTTCGAACCTCACCTCCGATA
TGCCACTGAAGGGCAAGCAGTTAGTGGTGTACCCCTGCCAAACACTTTGG
GGGCCCTTAGTTTTTCCCACAACCACAACCCTTGCATTTTGCGGTGGGAA
GAGTCCCTCCTGCTATGGTGGAAAGGGAAAAATTCAATCAGAGAGAGGAA
AGACTGAGGGCTATTGAAGGAGGCGGAGATCATGCTTTTGCTAACATGGG
CAGAGTTGTACCTAGTGCCTAACGTCGTCATCCCTCCGAAGTTCAAGGTG
TCAGATTTCGATAAGTACAAGGGGACTACTTGCCCCAAGAATCACTTGAA
GATATATTGCAGGAAAATGGGGGCATACGCGAAAGATGAAAAATTATTG
ATGCATTTCTTTCAGGAAAGTCTTACTGAGATAGTCGTCACCTAGTATAC
CAATTTGGAACCTTCCCGAGTCCATTCTTGGAAGGACCTAATGGTTGCCT
TCATTAGGCAGTATCAATACAATTCTGATATGGCTCCGGATAGAATGCAG
CTACAGAACATGTGCAAGAAGGAGCATGAATCTTTCAAAGAATACGCCCA
AAGGTGGAGGGATATGGCAACTCAAGTAGCGCCCCCAATGATGGAGAGGA
AGATGATAACAATGATAGTAGACATGTTACCGATGTTCTACTATGAGAAG
ATGGTGGGTTACATGCCTTCAAGCTTTGTTGATTTGGTTTTCGCCAGCGA
AAGGATCAAAGTGGATCTAAGAAGAGGAAAATTTAATTATCCTACTTGGA
TGAATATGAAGCTTGGGGAAAATGGAGAGAATAAGAAGGAGGGAAGAACC
CGTGCTATGACTGTTGTCCCTACATGGCCAAATTTCTCGCCAACTTAACA
ATGTCAACACTCAGCCAATATCAGTCCTTCTCATTGCCCACCACCCTACC
AGTCAAGAACACCCAATCATCCACAAAGGCCACCCCTAAATCAGCCGCAA
AGCCCTCCTGTCGCACATCCGATATCAAACACCACCCTTAACACAAACCA
AAACACTAACCAAGGAAGGAATTTTCTAGAAAAGAAGCCTGTAGAATTCA
CCCCAATTCCCGTGTCGTATGCTAATTTGCTCCCATATCTACTTAATAAT
GCAATGGTAGTCATAATCCCAACAAAGATTCCTCAACCTCCATTTTCCCG
AGGATACAACTTGAATGCAAAATGTGCTTATCATGGAGGAGTTCCTGGGA
ATTCCATTGAGCATTGTATGACCCTGAAACGTAAGGTGCAAAGTCTAATT
GAAATTCGAGGAGGACAATCGCTTACGAATTCTAACGTTGTCAAGCTACA
CTATGCATGGGGCAATTTGAAGGTTGTTGTTAGATGTCTCCAATGACTCA
TTAGGATTTTTAAGTTTATGGCATTATTATAAACAATAGTCACAATGCTA
ATAATATGGATAAATTTGATGTCCTTGTCTCTCATTCTCTCGCAATTACG
TCTTTGCTTATTTTACTTTCACTGGAATGTGAATGTAAGCCATTGGTTTG
TTGGCTCAAGCAACCTGCACTTCTGAGTTGATCTCCAAGTCTGTTCAATC
AGAAATTGCTCGTTCTACACGTTTGGTGAGGGTGCCGTAAACGACGAGTA
AAGTAAAAAAAAAAACGTTTGATTAATCGTGTTTCAAATAAAAAATAAGAA

FIGURE 26UU

```
GTAAAAACATTCATGTGACCTTATTTTATCATTCTTAAAAGTTTTCTTTT
TGAGAGAAAAGTGAATTATCAAGAACAAGAGTCGTTCGACTTAATCTGTC
AATTGAAAATCCTTTAAACATTTCTCATCCTTCGGAATTCATTTTTGAGA
ACCTGCATAGTTTCTTTCTTTTTTTCCTTGCTACAAGGTCATGACAAAAG
GCAACAATAGATACCTCAGAGCCCTACATTGGGGCAATGAGAGGCACCAT
GCATGAGCCTCAAGCAAACTTAGGGGCAGATCAGAAGTTCTTACCCGATA
GGTTCAGAACCTGAAAGGGTGACCTAGGCAAAAGTTAGGGTAATAATAAA
AAAGAAAAAAAACAAACAATTAGGGGCGTGTTATTAAGGTTTTGTCTCAA
AATCCAAACTACAAAAGTATCTAGTCAAGATTTGAAATGACACATGGCCA
TGTTTCAACATCCCAAACACTAATTTATCCCTTGCTACCCTCTCCGAACC
AAAGCATATTTGTTTTCGAAAAACAACAAAAACAAAATAGGAACTCTGAG
TAGGAACCACTGCTAAACTGGTGGGAACAGCAATGCAAACAACACATGCA
TGAAGTTGGGAAACAATAATAAAAAAAGAGAGATAAAGTCCGCCAAAGGC
GAGTGAAGAAAAAAAAAGAGACAAAAGATCTCCAAATCTTACAAGAAAGG
CACAAAAGTGCAATAAAGATTACTGTATAAGACAAAAGGAGTAGAGCTCA
ACCCAAAAGGTATAAGCAATGCTCTTGAGGTTCTTACTCAATGTAACCCT
TAAACACTCTTTAAGCCTCTCTAAATCCTTTCTTTCATAGTCTTCTTACC
CCTGACCACGTTACAAGCCCAGTAAAGCCCATGTGGATCAAGGAATGACT
AATTTTTCTTTTAAGTTGGGATTCTAGAATGAAACCTACACACGCTTGTG
ATTGTTAAAAAAATATATATATAAACAAAACAAAAAGAATCCTCGAGGTT
TTGTACTTGCACATTTGAGAAGAAAACTCATTCGACCAGGAGCTCATGGA
AAATTCCCAAAGACAATTGTGATAGTAGGGTACATCTGAGAAGAAAACTC
ATTCGACCAGGAGCTCATGGAAAATTCCCAAAGACAATTGTGATAGTAGG
GTACATCTGATATTAGTTGCTCATGCAGACTCCTTAGAATTCCTTTTGAA
TCCAGGGTGGCCTTTGTGGTATAAATTCTTTCGGGATTAGCCCATTTCAT
CAAGTTTCAGTGGAATCGACAAACCCTTGGCATCACTCTATGACCTTAAA
TCAGGAAAGTTTCACTTGGTCACATACCAAAGTGTGACAATTCATTGCCA
TCCTTCAGTGTGGTGCACAATCGATCCCAAAGCCTTATGTTTTCTTGCTG
TGCAGAACAATAGAAGGTTTTAAACAAAAAAGAAAGGGACAAACCCTAGG
ATCAATGTTTCGGTTGATTGATTAAATGTAAAACAGCTCCATTGCCGTCA
CTCCAAAATTTTCAAGTGATCAAACAAAAACATACACTCTAAGGGAGTCA
TCGAAGAGATTTGCAAAAAAAAAAAAAATAAGGTTGCATGAATTATCATG
TCTTCTAGAAAGAGACAGTCAATATGTGTTTTCCACAAAAAAAAAAAATCA
AATCAAAATCAAAATCACAAAAATAGGAAAGAATGTCATGAGCATTACAC
AATTTTCATGATTCAAAACCTTTTGCATTATTAGCATTTCAAGATGAAGG
TTGCATGCATCTGCATCCCAAAATCATGTTCATATTAGGCTATAAGTGCG
TAGATTTCTCTTTATATACCACTTTACCAAATCTAATTTTTTAAGTTAAG
GATGAGAGGCCCTCTCAAAAAGTCGATCTCTTGCTTTCTCTTAAGGTTGA
GCCCATTGGTACTAGTGCTTATTGGCTTGTTTTAGAGGATTCAAAGTCCT
CACCTTTATCTTTTAGAGGACTTAAGATCCTCGCCTTTATCTTTTAGAGG
ACTCAAAGTCCTTGCCTTTATTTTTCCCAGGATTGAAATTCCTCGCTTTT
ATCTTTCACAAGACTCAAAGTCCTCACTTTTATCTTTCATAGGACTCAAA
GTCCTCACATAATTTTGAAGTCACATTTTTGCACATTCGATTAAAGGCTG
TCGTCTCTTGTGACGGGCGTGTGGGGTGCTAATACCTTCCCCGTGTGTAA
ACAACTCCCGAACCCTTATTTTCAAAATCCGCAGACCTCTTTTTGGTTTT
TTCTAATGTTTTCCTTGAATAAACGTTGGTGGCGACTCTACGCGCTTTCT
TCATGAGAAGACGCAACTTTGGCTTTTCGCCTCGCCGTCCCGTCGAAGGG
TAGGTTGCGACACTTTGATATAGGTTATGACGCCTTCTAGTGTGGTAAAG
TCCGATAGGGTCCTGCAACATGTGTAACTATTTTTTGGCCTTTGGATATA
TCTATTACTCAATGTGTTTGCAAGTTTCTCTTATCTCAACCGTCCAAGAT
CGCTTCCTTTTTTTTAAAAATAGATTATTTTATTTTTAATCTAACAATCA
AGATTTTTTTGTTATTTGTTTTTTCTTTTTAGCCTTTCTATCTTTATCTC
TTTCCGGTGAGAAATATAATGAAGATGTATTTACATATCCAAAGACAACA
AATACAACAACAAAAATCATATAATAAAATAATACGATACAATTAAACAA
TTTTCAATTGAATCAAGTAATAGAACAGATCTAAAGAATTTCGTGAAAAA
TCTTAATCTTTAAAATCAACCATCAACAATTGTTAACATATTTGAAAATT
TTCATGAAAAAACAAATTTCTTATCTCCCAGATGAGTTTAACGAGATCCT
TGTGCATAGATTGTTGTACACCAACACTTTTGACAAAGCTTTTTTTTCAA
GCCTAAACCACCATCTGTGGAAGCAAAGCTTCATGATGAATCAACAATGA
TTCAAAGGTGTTTTGATGATAACAATGATGACAACAAAAGATGATGACAA
TGGTGATGAACAAAAAGTTCAAAAGATCAAAGAAAAACTCAAGTGAATCA
AAGAACATCTCAAGTGAATCAAGAACAAGTCAAGAGTTCAAGAATCAAGA
AGAATTCAAGACTCAAGAAGAAAGCCTACAATCAAGAATCAAGATTCAAG
ATCTCAAGAATCAAGATCAAGATTCAAGACTCAAGATTCAAGACTCAAGA
TTCAAGAATAAAGAAAGGACTCAATCAAGATAAGTATTAAAAAGTTTTTC
AAAACTTTGAACAACACATGAGTTTTTGACAAAACCTTTACCAAAGAGTT
TTTACTCTCTGGTAATCGATTACCATATTGTTGTAATCGATTACCAGTAG
CAAAATGAGTTTGAAAAAGTTTTCAAACTGAATTTACAACGTTCCAAATA
TTTTCAAAAGGCTGTAATCGATTACAATGTTTTGGTAATCGATTACCAGT
GTCCTTGAACGTTGAAATTCAAATTTAAAAGTGAAGAGTCACATTGTTTC
```

FIGURE 26VV

ACTCAAAAGCTTTGTGTAATCGATTACACATATTTGGTAATCGATTACCA
GTGTTTGTTTTTAAAAATCTAAAGATGTAACTCTTCAAAAAGGTTTTGA
CTTTTTCAAATGGGTTTTAAGTTTTTCTAAAAAGTTATAACTCTTCTGAA
TGGCCTTCTTGACCAGACATCAAGAGTTTATAAAAGCAAGACTTTGTTTT
GCATTCCGAATCAATCTTTCCAACAACAATCTTGAACAATTATTCATACA
ATCCTTTACAAGCCTTGAATCTCTTTGAATCTCTTTGAACTTCTTCTTCT
TCTTTGTACCAAAAGCTTTCTGAAGTTTTCTGGTTTTCTAAACCTTGAAA
ACTTGTGCTATTCATCCTTTTCATTCTCTTCTCCCTTTGCCATTTGCCAA
GGACTAACCGCCTGAATTCTTTTTGTGTCTCTCTTCTCCCTTTTCCAAAA
GAACAAAGGACTAACCGCTTGAATTCTTTTGTGTCTCCCTTCTCCCTTGT
CAAAGAATTCAAAACGACACAGTCTGAGAATTCTTTTGATTCTTCCCATT
CCCTAATACAAAAGCGTTCAAAGGTTTAACCGCCTGAGAATTCTTTTGTA
TCCCCATTCACAAAGTATTAAAGGTTTAAAAGCCTGAGATCTTTGTCTTA
ACACATTGGAGGGTACATCCTTTGTGGTACAAGTAGAGGGTACATCTACT
TGGGTTTGACTGAGAACAAGATAGGGTACATCTCTTGTGGATCAGTTCTA
GTGGAGGGTACATCCACTAAGGTTTCAAAGAGAACAAGGGAGGGTACATC
CCTTGTGGATCTTTGCTTGTAAAAGGATTTTTACAAGGTTGAAAGAAATC
TCAAGGACCGCAGGTCGCTTGGGGACTGGAGGTAGGCACGGGTTGTTGCC
GAACCAGTATAAAAACTCTTGTGTGTTTGTTTCCTTCTTCCATACTCTTT
TACTTTCCACTGTGCATTTAATTTTCGCTTTTACTTTCTGTTAAGTTTCT
CTTCTACTCCATATTCTCTTAACAACAAAAGTAAAAGCCTTAAAAGAGTA
ATTTTTAATTGGTAAAGTTTTTGGAATAATTAATTCAACCCCCCCCCCCT
TCTTAATTATTCTGAGGCCACTCGATCCAACAAGTGGTATCAGAGCAGGT
TTCTTGTAGGATGGCCTCCTCAAATCCCTTGTTTCCTGAAGGAAATTCTA
TTCACAGACCACCCATTTTCAATGGTGAGGGTTACCATTATTGGAAAACC
CGCATGCAAATATTCATTGAAGCCATAGATCTAAATATATGGAAGCAAT
AGAATTAGGACCACATATACCCACTATACTATATGTAACCCTCAGTTCTT
TAACCCCAAAACCCTAGAATCACTTGGACAGATGAAGATCCGAGAAAAAT
CCAGTACGATCTCAAAGCCAAAAATATCATCACTTCAGCCCTAGGGATAG
ATGAGTACTTTAGAGTGTCAAATTGTACTAATGCCAAGGATATGTGGGAT
ACTCTCCAGTTAACCC
ATGAAGGGAACCACAGATGTAAAAAGTTCTAGAA
TAAATACTCTTACCCATGAATATGAGTTATTTAGGATGAATCCAAATGAA
AACATTCAGAATTTACAAAAAAGGTTTACACATATTGTAAATCATCTTGC
ATCATTAGGAAAAGTTTTTCCTAATGAGGATTTAATTAATAAAGTCTTAA
GATGTTTAAGTAGGGAATGGCAGCCCAAGGTAACTGCTATTTCTGAAAGC
AAAGATCTCTCTTCCATGTCTCTTGCCACTTTATTTGGTAAATTGCAGGA
ACACGAGATGGAACTTCAACGCCTCAATCAGAATGAAGAAAATGACAAAA
AGAAGAGAAGCATAGCCCTTAAAGCCTCATCTTCAATACAAGAAGAAAAC
GAAGAAGAAGATTCTGATGATGAAGATTTTTCCTTCTTTGTTAAGAAATT
TCAGAAATACATCAAGAAAAGAAGAATTGATAGGCGTCAGAATTTCAATA
ATGGAAGAAAATCACAAGAGGATTCTCAAGTCCTTAGGTGTTACAAATGC
AACCAAATTGGTCACATCAAGGCCAACTGTCCGTCAAATGAAGAATGGTC
GGAGAAAAGTGAAAAGAAAAGATTTGACGAAAGAAGAACTAAGAAAGCAT
ACATTGCATGGGATGACAATGATTCATCTGATGGTTCAGAAAAGGAGATT
AATCTTCTAACTAAAGATTATGAAAGTGACAAGAACTTCTCTCAAGGATA
A
AAAGCATGATCCTCATCTTTGAAGATCTAGACTCTTCAATTCTGAAAAA
GGTAATATCAAAACCATTATCTTATTAAAATTTCTCTTAAAGTTGAAATT
TTTATTCAAACAAATTGACTATGATGACTAAAAATTCTTTATTTGTTTGT
CTTTTGATTGATTGAAATCATGAGTATATTTGCTTGATTGATTTCATTCT
ATTTGCATGAAATATTCATTCATTTATTTAAGTAAAATCAATATTCTTCA
TACTTGTGTTGTAATTGTTCTTGATAAAATTGATTATCTTCATGTTTTAA
ATATTTTTGCATGACGTGATATGTAAATTACATGAGTGAAAATTAGTCAT
AAAGTATTTTCAAATATAGTATTTTCAAAAATAGTTTTCAAAACTTCTTC
TCTCCTAGAAAGCCTTCTATTTTTGTTTTCTGGCTAAAATAACCACTGGT
AATCGATTACCATAATAGTGTAATCGATTACAAGCAGTTATTTCTGGCAA
AGTTGCTCTCTGGTAATCGATTACCATATTGTGTGTAATCGATTACGATG
CGTCCCTGCACCTATTTATTCAAATTTCAAATTCTGAAACCTGCAACTTT
TCATTCTCTCGAAAACCCTCGCCCCCAATTTTTCTTCCAGCCATATCTCA
CTCAATTCTTATCCAAATCACTCCCCACAAAGCCCAAACTTCATCTTTTT
TCAATCTCTTTCATTTGAACCGATTGAAATCCCAAAAAAACTCTTCAAAT
GGCAGAACCATCGAAAAAGAGAAAAGGAACTTCGAGTCGGAGTCAGCTGC
ATTCCGGGTCACAAGAAGCACCAATTCCTCCCTCCATTCCCTCTGGATCA
TTATTCTCATCAGAGGAACAGCGTATACGGTACACAAACCTCTTTTCCTC
TCGTTCCATTGTAGACCCAAAATTCATAGATATGGAGTTCTTCTCAAATG
AGAATTTTGAATGCTTCCAAGCATTTGAAAACTCCAATCTTATTCCATTC
ATGTCTCTGAAATTACCTGTCTATTCTGAATTAGTCAAAGCTGAAATTCT
GATACTGAGGACAGATGTCGTACAGGATGTCACGACATCGCGCTTCAGAA
CATGCAGATTGTATATGACAGTATGAACAGATTAAACAAGTAAATAACAC

FIGURE 26WW

AAGAGAATTGTTAACCCAGTTCGGTGCAACGTCACCTACATCTGGGGCT
ACCAAGCCAGGGAGGAAATCCACTAAAATAGTATTAGTTCGAAGATCTAA
CAGCCACTGTATACAACCTTCTCACCTAACCACTACCCATGCAACTTCTA
CCTAAGAGCCACTCTTAGATATGAGAACCCCTCTCACTCCCTCTCAATCA
CTCACCCGTGTTTACAAACAAATCAAAGACACACCAGAGATTGCTCTCTG
AACAATAGAGATCAACTCTACACACTCAGGTCCAACACTTGATGTTAGGG
TAACATCAAGGTGGCTCACAAAACACTCAAGTCACAAAACTCACAAAATA
ACTCTTCAATCTCTGACTTGATAAAAAACCCGTGCAGCCTTCATGTTTAT
ATAGCAGTGTACGTATCTGGGCTGCAACAACTTCCGCTGGATAAGCTCTA
TCATTCTCCTGAAAAATCTGCACTTAAAGATCTAAAAGATAAAGTTTTAT
CTTTTAGTTTTTATCTTCAATCTCTAATCCCTGAACGAAACTATTCAAGT
TTGTAATTCAATCTTTAATTATCTTTTAATTCGTTCCTAAAGATAGAGCT
CCTAATCTGTTGCTGACTGCACATTAATCTGTTAAAGATATAACAGATTT
ATGTGTCCAGTATTTTCGGGCAGGATGTCCTGGACATTGTATCCGACATC
GTGGATCCTGCAGCTTCAATTCTTCATTTGACATTTTATCTTGCCTTGTG
CATTGTGCACCCCAATCTGATTCCTTGACATAATGTTAGACATCATGTGC
AGCAACTCCAGCTTTCCTTCATTGTCTAAGTGCTTTATGTTTTAACAAAA
TTTTAGCCAATCTTTTAAAACTAAGTAAAGCTAAGCACTAACAATCTCCC
CCTTTGGCAAATTTTGTCTAAAACATACTTAGACACTTCCTGAGCAGGTA
CGAGCAGTCATGCAAGTGGGATCAGCAACTTTCATTATCAGAGTAATCAA
GCACAGCAGTATCTGTAGTGGTGACAGCAAAATTCTGCAAGTTGCAAATC
TACAAGTCTTTTCCAGGATGTCAAGACATCTCACGTGACATCAGCTTTCT
GCTCCCCCTGTCTCCATGCTCTTACTGCTGTGAAGTGAATATTCTGCTAG
GCAGCAGTTCACTGCAGCATCTTCTATCAGCTACTAGTTTCAGTAGCTTA
CATCAATCATCATCAGCAGCAGCAGTATAAATACTACTCCCCCTCAAAAT
CATAAATCATGCATAATATCCTTCATAAATCATGCATAATATCCTACTAC
TCCCCCTTTTTAGACAGAATTTGGCAAAAGTAGAAGGCATGAAATTAATG
TGCAAATATTACAGACCAATAACAATCAATTGTTCAAAGGGACATGCCCC
AATAGCTAGTCATGGGGTGGCATCAGAATCATCATCATCTGATTCTGTAT
CCTCTGCTGCATCTTCTTCTTCCTCAGCTGCTTCTCCATCATCAACGCCA
TTGTCTGAGAGTCTTTTGACCAGGCGTTCCAGCTCCATTTTCTTCTCTGT
GTTGGCTTTGATGGTTGCCTCCAGCACCTTGCATGTGTCCTTGAGTTCAG
CAATCAAATCATCCTTGGACACAGCACCTGAAGCAGCAGCTTTCCCTAAT
GTCGAGACAATGTCTGGGACATGTGTCCCCCTCAAATAGTTTGTAATGCA
GGGATAGAGGAGATTCTCTCTTCTTCACAGAGTCAATGTTGTTTAAAATA
TTGGGATGTTGACTCAACATAATGCCACACAATACAGTTGGGAAGGCAAT
GGGTAATTTGACAGCAAAAGATTCTGAATGCTTAATAGTTTGATCAAAAA
TATAGTTTCCAAAATTAAATTTGGACTTGGTTCCAACAGCATACAGAAAT
TTACCCAAACCTGTGGCAACAATGGAAGTATGATTGGGTGGGTACCCCAG
TTGGCAGTGCCAATCCTATGTAGGATTGCATACTTCACACTTAGCTTCCC
TGCAGACAGCTTCCCTTTCTTTGGCCAATGCTGGACTTGCTTGGCAGTGA
TTTCCTTGGCAATTTGATGCTCAGAAACAGCAATATCCACCACTCCTTCA
GTTGGTCTGCCCAGGTACTTGTTGATTACAGCAGGGGAGAATCTAATACA
TTTTCCTCTGACAAACACTTTCTGATACTCATCACTCTTTCTGTTTGTTA
TGTCAGAGGGAATGTTGACAATGAATTCCCTGACTAGACTTTCATAACAA
TCTCCCAACTTGGTGACAGTTTTCAGCAGTCCAGCAGCCTTGATGAGGTC
CATGATCTCCTTGCAATCCAAGGCATCTCTTCCCAGTTCTCTTTCTAAAG
CAAGTCTGCGTTGATATACAAATTTCCACCTTTCAACATTGCCAATGGAG
TGGAATGAAATGTTGTCCAATGGGGCATCAGGGACATTTCCAGGCACCTT
TTTCCCTGATTTCTTGGCTCTCTTGATGTCGGGAACATCTAGTTCGACAT
CATCATCAGAATCAGATGAGGAAATTTCTTTCCTCTTCTTGGAAGGGATT
GCAACTTTGCTCCATCTGGATGTGGTAGGAGTGATTGGTGTGCTCTTCTT
CTGTGCAGTAGTTTTGATTCGTCCAGACCTAGTAATGGGGGTTTTTCCCT
TTCTGCTTTGTAATCTTTCTGCAATGCCAGGTGCCAACTTTTTGGCAATG
GGTTCCTCATCAGATTCTACTTCTTCTAGGTCAATGAAGTCACCTGGAGC
AGGTTCTGGTGCCCTTGGTGCAGGGGTCTCCTCTGTGGCTTGATCCTCTT
CCTCTGTTGATTTCTCTTTACTGGATGAAGAGAGGACTTCAGCATTTGGG
GTGGAAGATGTTGGGACATCTTTATCAGCATCAGGGACAGAAGCATTTTT
CAAAATGCTATTCACAAAACTGCGGATCTTCTTATCCATCTCAGTGTCTT
CTTCCCTAGGGCTTGTTGCAAAGCTAGGGTTTTCAGAAATCTTCACTCCC
TGTTGTCTTTTAGGGACCAGTTTCTCAGGAACAGGGCCTGGACCAGGAAT
CATTTGTATGGATTGGATATTGAGTGCAGGTTGTTCCTGGTTTGATGGAG
TTTTGGAGGATGATGGAGATGATGGTACAGAGGGTGAAACAGGGGATGAG
GTTTCTTTTGGTGAGGTAGCCATGGAGAAGCAGAGCTTTGGGAGTGGTTT
CGTGAATATCTGAGAAGTGTTGGGGAATGCTGATGAAAACGAGATTGCCA
CGAAAATGTAAGTTTGAATGAGGAATGTAGGAGAACGTGTGAAACGGAGG
TTGAATTTGTTTTGGCCCAGTAGTGAACGTGCTATTAATGTTAAGTGAGA
AGTTTGAGCACGTTCAGATAGAAGTAACTGCTATAACTCCTCTAGCAGAC
AAATGCCCAGCTTGCCCCTCAGTTTTTCAAACTGATTTGCATCCAATGCC
TTTGTGAAAATATCTGCTACTTGTTCCTCAGTGGCAACATGCTCCAGTGT

FIGURE 26XX

GATAACTTTATCATCAACAAGATCTCTAATATAGTGATGTCTAATGTCAA
TGTGCTTGGTTCTGCTGTGTTGAACAGGATTTTTAGAAATATTAATAGCA
CTCATGTTGTCACAGTACAATGTCATGACATCTTGTTCGACATTGTACTC
CTTCAGCATCTGCTTCATCCAAACTAGTTGTGAACAGCTGCTTCCTGCTG
CAATATACTCTGCTTCTGCAGTAGATAGGGACACACAGTTCTGCTTCTTG
CTGAACCATGAAATAAGATTGTTTCCCAAATAGAAACATCCACCAGAAGT
GCTTTTTCTGTCATCTGCACTTCCAGCCCAATCAGCATCACAATATCCAA
CCAGCATTGAATCTGAACAATGACAGTACATAATTCCATAGTCACTGGTG
CCATTTACATATTTCAGAATTCTCTTTACTTGATTCAAGTGACTTATCTT
GGGATTGGCTTGATATCTTGCACAAACACCTACTGCAAAGGTGATGTCAG
GTCTGCTTGCTGTTAAATATAGTAAGCTCCCAATCATGCTTCTGTACAGA
CTTTGATCAACACTGGTGCCAGCTTCATCCTTTGACAGCTTCAAGTGAGT
AGGTGCAGGTGTTCTTTTATGGCTGGCATTTTCCATCCCAAACTTCTTGA
CAATGTTCTTTGCATACTTGCTTTGTGAGAGGAATATGGAGTCTTCCATC
TGCTTCACTTGGAGTCCCAGAAAATAAGTCAGCTCTCCAACAAGACTCAT
CTCAAATTCAGATTGCATCTGTTGGACAAAATGTCGAAGCATCTCATTCG
ACATCCCTCCAAACACAATGTCATCAACATATATCTGTGCTATCATCAAG
TTTTCAGCATCTTGTTTGACAAAGAGAGTCTTGTCAATTCCTCCCTTCCT
ATACCCTTGCTGAGTAAGGAACTCTGTTAGCCTTTCATACCAAGCTCTTG
GAGCTTGCTTCAATCCATAGAGAGCCTTCTTGAGCCTGTATACATGATCT
GGATGAGTTGGATCTACAAATCCCTTTGGCTGCTCCACATAGACTTCTTC
ATTCAGGTATCCATTCAGAAACGCGCTCTTCACATCCATCTGGTACAGCT
TGAATTTGAGGATGCAAGCTACACCAAGTAACAATCTGATGGACTCAAGT
CTAGCAACAGGGGCGAAAGTTTCATCAAAGTCTACACCTTCAATCTGAGT
GTAGCCTTGAGTAACAAGTCTGGCCTTGTTTCTGGTTATAACACCTTCTT
CATTGGTTTTGTTCTTGAAGATCCACTTGGTGCCAATCACATTAGTTCCC
TCGGGTCTAGGAACTAGCTCCCAAACTTCATTCCTTTTGAATTGCTCCAA
TTCTTCTTGCATAGCATTGATCCAGAACTCATCAGTCAGTGCCTCTTTCA
CATTCTTTGGCTCAGTTTTGGAGACAAAGCATGAATTGGAGACAATCTCA
ATCTCCCTTGATCTTGTAGTGACTCCTCTGTTTGGATCTCCTATAATCAG
CTCCTTGGGGTGCATCTTCTGGATTCTAATGGAGGGACTCTTGTCAGGTT
GATTGATGTTTGGTTCATCTGTAGCAGAATCAGAGTTTTCTGCATTTTCT
GCATTTTCTGCACTTTTAGCTGTATCTGCTACATTGTCTCCCGATGTTCT
GACATCGTCTTCGACATCCTTCTTTCTTGCTGGAGTTAGATCATCAACAA
CCACATTGATGGATTCCATCACAGTTCTGGTTCTGGAATTGAATACTCTA
TATGCTCTGCTGTTTGTAGAGTATCCCAAGAATATTCCTGCATCACTCTT
GGGATCCATCTTTCTCCTTTGCTCTCTATCTGCCAAAATGTAACATGGAC
TTCCAAAGATGTGGAAGTGCTTGACAGTTGGCTTCCTCCCTTTCCAGATT
TCATACAGTGTGGTTGGAGTCCCTCTTCTAAGTGTGACTCTGTTGTGGAT
ATAGCATGCTGTGTTCATGGCTTCAGCCCAGAGATTATAGGGAAGTTCTT
TGGCATGAAGCATGACCCTAGCAGCTTCTTGCAAAGTCCTGTTTTTCCTT
TCAACTATGCCATTTTGTTGTGGTGTGATGGCTGCAGAGAACTCATGAGT
GATGCCTTCAGATGTGCAGAATTCAGTAAACTTGGTTTTTTCAAACTCTC
TGCCATGGTCACTCCTAATTCTCTTGATGACACAGTCTTTTTCTCTTTGA
AGTCTTAGACTCAACTCTTTGAATACTTCAAAGGTGTCTGATTTCTCTCT
GATAAAGTTGACCCAGGTAAATCTGGAGAAATCATCCACAACAACATAGG
CATACCTCTTTCCTCCAAGGCTTTCAACTTGCATAGGCCCCATCAAGTCC
ATGTGAAGTAGTTCCAGCACCCTGGAAGTGGTCTGATGTTGAAGCTTCTG
GTGGGACATCTTGACTTGCTTTCCAATCTGACATTCACCACAGATTCTGC
CTTCTTCTATTTTCAGATTGGGAATGCCTCTAACAGCACCTTTGTCAATG
ATTTTCTTCATGCCTCTTAAGTGCAGATGTCCAAATCTTTGATGCCATAT
TTTGACTTCATCTTCTTTGGAGGATAGACATGTGGAGGAGTAACTGGTTT
CTTGAGGTGTCCATAGGTAACAGTTGTCCTTTGATCTGCTGCCCTTCATT
AGAACTTCACTCTTCTCATTTGTCACCAAGCATTCTGACTTTGTGAAGTT
TACATTGAATCCTTCATCACACAACTGACTGATGCTGATCAAGTTTGCAG
TCAGTCCCTTCACCAGCAGTACTTTGTTCAGACTAGGAAGTCCATCATGG
ACTAGCTTTCCCATTCCAGTGATCTTTCCTTTAGAGCCATCTCCAAATGT
CACATAGCTAGTGGAGCAAGGTTCAATGTTCACCAGGAATTCTTTAACTC
CTGTCATGTGTCTGGAACAGCCGCTATCTAGGTACCAATCTTCCTTAGCT
GATGCTCTAAGTGAAGTATGAACAACAAGACTAACAATCTTGTGTTTTGG
AACCCACATCATCTTCCTTCCGCTGCTGCTACTTTGAGTTCCATGATGTG
GATGGCCATGTAGATGATAGCAAAAAGGCTTTATGTGACCATACTTGCCA
CAGTAGTGACACCTCCACTTCTTTCTTTTGCTCTTTTTCTGCTGCGTTCC
ATGATGTCGAGACCGATGTTGTGACATCGTGGCTCCAGTGCTGTTTTTGG
CAGGAACAAATTCTGTCATGGTTGTTCTGCCAGCAGATTTATGATTAAAT
CCAAGTCCTCTCTGGTTTCCAACATTCTTCCCAAGCTGTAGCATCTCATC
AAGCATATCTGAGCCTTTATTCAGCATCTTTATTGATTTTGTCATGTTTT
CCAGTTTAGAGTTCAGAAAACCAATTTCTCCTTTAAGCTCAGAGATCTCC
TCTTCATGTGCCTCCTTCTCAGCCTCCAGATTTGCAATGATCTTCTTCAG
TTGAGCTTCTTGCTGAAGAATCTTCTCACTTTTGATGCATAGTTCTCTAT

FIGURE 26YY

```
AGGATATAGCAAGCTCATCAAAAGTGATTTCAATATCAATATCACTTGAA
TCTTCATCAGATTCAAATCTCCCAGTGAGTGCATTCACATCTCTATCAGA
ATCACTTTCTTGTTCACTCTCTGTATCATCTGACCAACATACAGAAAGTC
CTTTCCTCTGCTTCTTGAGATGGGTGGGACATTCAGCTTTGATGTGTCCA
TAGCCTTCACACCCATGGCATTGAATTCCTTTGCTGTGACTGGGCTTTTC
ATCTGACTTCTTCTGGTATTCACTACCTTTCCTGATGTCGAAAGGGATGT
TCCGGACATGTGGTTTCTGCCTCCTGTCCATTCTTTTCAGCACTTTGTTG
AACTGTTTTCCAAGGAGCACAACTGCGTTAGTCAGACCTTCATCAGTATC
CAGGTCATACTCATCTTCTTCTCCTTCATCATTGGACACGAACGCCAGGT
TCTTGCTCTTCTTTTCAGTCCTATCCGAGAGTCCTAGCTCAAAGGTTTGA
AGGGAACCAATGAGTTCATCTACTCTCATGTTGCAAATGTCTTGGGCCTC
CTCTATTGCAGTGACTTTCATGTCAAATCTCTTAGGCAAAGATCTGAGGA
TCTTTCTCACCAGCTTTTCATCTGTCATCCTTTCTCCCAAGGCAGTGCAA
GCATTGGCAATTTCAAGAATGTTCATGTGGAAGTCATGAATGCATTCTTC
CTCCTTCATCTTCAGATTTTCGAATTTTGTAGCCAATAGTTGCAATCTGG
ACATCTTCACTTTGGAGGTTCCTTCATGAGTGGTTTTCAGAATCTCCCAT
GCATCCTTGGCAACTGTGCATGTGTTGATCAATCTGAAGATATTCTTGTC
AACTCCATTGAATAGGGCATTCAAGGCTTTGGAGTTTCCAAGTGCCAATT
CGTCTTCTTCTTTTGTCCAGTCTTCTTCTGGCTTCAATTCATCAGTGGGC
TTTCCTTCTGTGTCCAGCATCTTGGGATGTTCCCAGCCTTTGATGACAGC
TTTCCAGGTTCTGCTATCCAGTGATTTGAGGAAGGCCACCATCCTTGCTT
TCCAGTATTCATAGTTGGTTCCATCCAGAATTGGTGGTCTGTTCACTGGT
CCTCCTTCTTTCTCCATGTTCATCAGAATTTATCTCCCTAGATCTCACTC
AGTGATTTAGAGTGCCTGCTCTGATACCAATTGAAATTCTGATACTGAGG
ACAGATGTCGTACAGGATGTCACGACATCGCGCTTCAGAACATGCAGATT
GTATATGACAGTATgAACAGATTAAACAAGTAAATAACACAAGAGAATTG
T
TAACCCAGTTCGGTGCAACGTCACCTACATCTGGGGGCTACCAAGCCAGG
GAGGAAATCCACTAAAATAGTATTAGTTCGAAGATCTAACAGCCACTGTA
TACAACCTTCTCACCTAACCACTACCCATGCAACTTCTACCTAAGAGC
CACTCTTAGATATGAGAACCCCTCTCACTCCCTCTCAATCACTCACCCGT
GTTTACAAACAAATCAAAGACACACCAGAGATTGCTCTCTGAACAATAGA
GATCAACTCTACACACTCAGGTCCAACACTTGATGTTAGGGTAACATCAA
GGTGGCTCACAAAACACTCAAGTCACAAAACTCACAAAATAACTCTTCAA
TCTCTGACTTGATAAAAAACCCGTGCAGCCTTCATGTTTATATAGCAGTG
TACGTATCTGGGCTGCAACAACTTCCGCTGGATAAGCTCTATCATTCTCC
TGAAAAATCTGCACTTAAAGATCTAAAAGATAAAGTTTTATCTTTTAGTT
TTTATCTTCAATCTCTAATCCCTGAACGAAACTATTCAAGTTTGTAATTC
AATCTTTAATTATCTTTTAATTCGTTCCTAAAGATAGAGCTCCTAATCTG
TTGCTGACTGCACATTAATCTGTTAAAGATATAACAGATTTATGTGTCCA
GTATTTTCGGGCAGGATGTCCTGGACATTGTATCCGACATCGTGGATCCT
GCAGCTTCAATTCTTCATTTGACATTTTATCTTGCCTTGTGCATTGTGCA
CCCCAATCTGATTCCTTGACATAATGTTAGACATCATGTGCAGCAACTCC
AGCTTTCCTTCATTGTCTAAGTGCTTTATGTTTTAACAAAATTTTAGCCA
ATCTTTTAAAACTAAGTAAAGCTAAGCACTAACAAAAGCCTTCTATTCTA
ATTTAGAAATTCATGAAGGTGTTCTAATGTCTGAAATCTATGGGATTAAG
ATGGGTCATTGACCAATCCCTGTTTTTTGACTTAACCAAATTGCCTAGTG
AAGGTATGACTTTTGAGGGTGCACTGATTGATGAATGGAAATTCGATTTC
TCTGTGCATGATGCCCGCCGATTGGTTTGCACCAACCAAGCGGATATGAC
TGGAAGACTTCTTGCTGGTTCATTGGCTTTTGAAAGCCGCATCCTCCATT
ACCTTATAGTTCGCATTTTGCTTCCTAGATCTTCAAACCTTGCCCAGGTT
TTTGAAGAAGATCTCATTGTCATGTGGGCCTTTCATAAAGGTTTACAAAT
TGATTGGGCACATCTTGTTAGATATCGCATGCATAAGGCGTTGCGATTGA
ATGCCCCGTTGCCTTATCCTCACCTTGTTACCCTCTTCCTTCAACATTTC
AACATCCCTCTTGATTCTGAACCTTATGTTCCAATCAAGAGATCATTCCT
TATAGGCGCTTCAGTCATAGCATCCTTTGGTTATATTAAGGAGCATGATG
GATCATGGGTAAAGAAGGGTGCTAGAAATATTGGTGAAGAAGGTCATGAG
GGAGAAGATTCATCTCTTCTTTCGAAGATTTTGGAAAGGTTTGATGGTCT
TCAAACCTTTGTTGGTGAGAGGTTTGATACTTTGGAACTGCAAGTGGATA
TGCGCTTCAATGAAATGGAGTCAAGAATGACTAAGGTTGAAGAAGATGTA
TCTTACATCCGGTCAAGCTTTGATCTTCCACCACCGCCGCCACCATCATC
TTAGACTTATATTTTAATATTACTACTTTGATTTTCAGCCTTGTATTTTG
GCTATATTACTATGGTATTTGAACAATTTATTATTTCCTTATTTGCATGG
TTTGGTTGAACAAGTATCTTATTTGACTATGTGGATTTTATAAGTTAATC
TATTTATGATTGTTACTTCATGGTTTTTACTTCATGTTGTGGTTAATATT
TTTTATGAATGCTGTATGAATGTTTAAGATATATTTGCATACTTTAAGTT
TAAATACACACTTTGGCTTTTTGTTGATGCCAAAGGGGGAGAGAAATAGG
GATAAATCAAGAACTCACATGAGTAAATAATTTAATTTTAAGATAAGCAT
AAATTCAAAAACAAAGGGGGAGCATTTATAAGAGTGATCGACTAGGAAAA
AGTGTGTGTGTGTTTCTTGATTTCTGAAGTTGTCATCATAAAAAAGGGGG
```

FIGURE 26ZZ

AGATTGTGGAAGCAAAGCTTCATGATGAATCAACAATGATTCAAAGGTGT
TTTGATGATAACAATGATGACAACAAAAGATGATGACAAAGGTGATGAAC
AAAAAGCTCAAAAGATCAAAGAAAAACTCAAGTGAATCAAAGAACATCTC
AAGTGAATCAAGAACAAGTCAAGAGTTCAAGAATCAAGAAGAATTCAAGA
CTCAAGAAGAAAGCCTACAATCAAGAATCAAGATTCAAGATGCAAGATCT
CAAGAATCAAGATCAAGATTCAAGACTCAAGATTCAAGAATAAAGAAAGG
ACTCAATCAAGATAAGTATTAAAAAGTTTTTCAAAACTTTGAACAGCACA
TGAGTTTTTGACAAAACCTTTACCAAAGAGTTTTTACTCTCTGGTAATCG
ATTACCATATTGTTGTAATCGATTACCAGTAGGAAAATGAGTTTGAAAAA
GTTTTCAAACTGAATTTACAACGTTCCAAATATTTTCAAAAGGCTGTAAT
CGATTACAATGTTTTGGTAATCGATTACCAGTGTCCTTGAACGTTGAAAT
TCAAATTTAAAAGTGAAGAGTCACATTGTTTCACTCAAAAGCTTTGTGTA
ATCGATTACACATATTTGGTAATCGATTACCAGTGTTTGTTTTTGAAAAA
TCTAAAGATGTAACTCTTCAAAAAGGTTTTGACTTTTTCAAATGGGTTTT
AAGTTTTTCTAAAAAGTTATAACTCTTCTGAATGGCCTTCTTGACCAGAC
ATCAAGAGTTTATAAAAGCAAGGCTTTGTTTTGCATTCCGAATCAATCTT
TCCAACAACAATCTTGAACAATTATTCATACAATCCTTTACAAGCCTTGA
ATCTCTTTGAACTTCTTCTTCTTCTTTGTACCAAAAGCTTTCTGAAGTTT
TTTGGTTTTCTAAACCTTGAAAACCTGTGCTATTCATCCTTTTCATTCTC
TTCTCCCTTTGCCATTCGCCAAGGATTAATCGCCTGAATTCTTTTTGTGT
CTCTCTTCTCCCTTTTCCTAAAGAAAAAAGGACTAACCGCCTGAATTCTT
TTGTGTCTCCCTTCTCCCTTGTCAAAGAATTCAAAATGACACAGTCTGAG
AATTCTTTTGATTCTTCCCATTCCCTAATACAAAAGCGTTCAAAGGTTTA
ACCGCCTGAGAATTCTTTTGTATCCCCATTCACAAAGTATCAAAGGTTTA
ACAGCCTGAGATCTTTGTCTTAACACATTGGAGGGTACATCCTTTGTGGT
ACAAGTAGAGGGTACATCTACTTGGGTTTGACTGAGAACAAGAGAGGGTA
CATCTCTTGTGGATTAGTTCTAGTGGAGGGTACATCCACTAGGGTTTCAA
AGAGAACAAGGGAGGGTACATCCCTTGTGGATCTTTGCTTGTAAAAGGAT
TTTTACAAGGTTGAAAGAAATCTCAAGGACCCCAGGTCGCTTGAGGACTG
GAGGTAGGCACGGGTTGTTGCCGAACCAGTATAAAAACTCTTGTGTGTTT
GTTTCCTTCTTCCCTACTCTTTTACTTTCCGTTGTGCATTTAATTTTCGC
TTTTACTTTCTGTTAAGTTTCTCTTCTACTCCATATTCTCTTAACAACAA
AAGTAAAAGCCTTAAAAGAGTAATTTTTAATTGGTAAAGTTTTAGGAATA
ATTAATTCAACCCTCCCTTCTTAATTATTCTGAGGCCACTCGATCCAACA
CCATCAACATTCGCCTATGAAGGATAAATAGGGGTGTCACAAAGAAGAAA
CAATGGTCGGTATTATGATATCTTCAAAAAATAGATCTAGGTTTCCCATG
TGCACGATGTTGTCACTCGCTGCTTCTAACAAAAATGTCGGAAAGGTATT
TCATGGCCATTGTCTACTCCCACTACTAGAAAATATACTTTTAAAATCGC
TAGGCTAACATCATTTTTCGATACAATCGATGTTAATGAAAACACGATGG
CATAATCATAAATAACATGAATTCGTTGACATCGGTTTTTTCAAAAACCG
ATGTGAGTTCGTTAACATCAGTTTTTTAGAAATCAATGTTAATGAACTTT
TGTTAACATCATTTTTTTTGAAAAATTGTTGTTAACAAAACGCGTTAACA
TTGATTTTTGGAAAAAACCAACGTTGTGCTATCCTATTTATAATTTTCTT
TCGTGCTTCTCACTCTCACTCTCTCTGTCCATGGCGCTTCAGTCTCGCTC
TCACTCTCACCCTTCACCAGAGCTCTCACTCTCACCCTCGTGACAGTCCT
CTCCTTCGCGAAGGTCCTCGTGCTCAGTCTCACCACCATCACTCGCGAAG
GTTGTAACACCCTGATATATATATTATTAGTAATTATATTTGATGTTTGA
TTATTTTGTTGTGTTATTTGACTACATGATAGACTTGAATGAGTTGAACT
ATGCCCTTGAACTAGTCATGTGTGAATTTCTTGATATGGATGTTGAATTA
TGTGGAGTTTTGTTGAGCTAAGTTGAAAGTATGAGATTTTAGATTTTACC
AAAACCTAGTTCAATGAAATCGCGACACCAGATTCGTTAACTGTTGCATC
ATCTTCAAATTTTGTCTGGATATCCCTAAGATATGTTCCTACTGTCTGAC
CGTTGGGATCTTGAAAATAATAACTTTTAGTCTCCCGCTAAGCGAGAAAG
GCACGCTAAGCGCAATTCCAACCGAGGGGAATTGTGCTGAGCGGCCCAAA
GCTGCACTAAGCCCATTTCCAACCGAGAGGAAGTGCACTGAGCGCCCAGA
AGGCCCGCTAAGCAAATGTTGCAGGTTATAAATACGTCCTTAGCGTGAAA
AACACAATTTCACTCACCTCTTCCCCCAAAAACGTCTCCCAAACCCTAAA
ACCTTATTTTCCACCACCCAAGACCACCAGTGGCCGCTATGAGCCGCTGT
TGCTTGCCGTTGGACCCCCACACCAAGAGGAACACTTTAATCAGAGCAGA
ATCCTCAGAATTCGGTGGAGAAAATCCCTCAATCCTCCATTTCAAAGTTT
CTCTAAGGTAACCTTGACTTCTAAGCCTTCTCCTAGCTAGTTTGAGTTCC
TCTTAGTGTCTCTTATGTGTTGGGTACTGTTATAGGGTGTTTTTACACTT
CCTTTGAAAAATCCTAGAGAATGAGACATTGTAAAAGTTATCTTTTTATG
ACCTTGAGGTTATTTTTGCGGCATTCACTAAACCCCGGTCACATTGGCGT
GATCGGAATTTCAAAAAGATGTTTCTTTTCTGTAGAACCCGAAATACCCC
TCTATCCCTTATGTTTTGACAGTGGTATTTGACCCCGAATGTTTCCTTTG
ATCTTGTTTTTGAAGCCTATGCTAAATTCCTTTTGTTTTGGTGTAATAGA
GACTTGCGTTGGACTGACAAGCGTGAACGAGAGAGAGACCTCTAAGTGAT
GCAAAGAGAAACTGACGGAGAGCTCACGATAGGTGAGGGGAGTTATTATA
AAATTTACTATTTTGACACCATAGTTAGGGTCAGGGAACCTAGCTCTGAG

FIGURE 26AAA

AATATCTGCATGTCCCTATTGCATGCTGATTTTCTTTCAAGAAAAACTAT
GTTTTTAACGAATGGGATGCGATATATCTATTGTGGATGAATGACATAAT
ATTCATGTATTCGGTCAAACATTGGTGCGTGTTTGGGGACAATATATATA
TATATATATATATATATATATATATATATATATATATATATATATATATA
TATATATATATATTTGTGAAATTCAAATATTACTATGATTTTCATAAGTA
AAAATAATGGAGTTTTCATAAAAGAAAGAAAAAGAATTTAATTTTTCAGT
TATTAGAGTGGTGATATCGTAACGACGAGGCGGGTCATTACAAAGGTGCT
CCCGCGTTCTACTGTAACACCGTCACTGCCTCACCCATGTTTTGCTGCGA
CCTCGTCATTGTTTTGTATTATCTCTACCTTGCGACTTGAAGCCTTCTTT
GGTTTCATGTCCAATTCCCTCGTGACTTCCTCCCCAGGTTAGTACCTGAA
AATGTGTTCATTGAGAAATGCTTTTGCTTTATGTCTAAAATGTGCTCTTT
GTTCTTGAAAATGTGCGATGTTTGGTGTATTAACTGACTCATATTCGTAC
TGAAAGTGTGCTCTCTATTCCTAACACGAAACATGGTCCAAAAAGGTTTT
AAGCTAAGCTAGTTGAAGAAGCTGAATCTTATGATTCTTTAATCTTAATC
ACAAATTTTGTATCTCTGTCATATCATATCCATAGTTCGGGAATACTAAG
CTTGGGGATGATTGGTATCAATGTGTAGTACCTTTGTATTGTCTTCGTGG
GTGGAAAATGTGTTCATTGGGTTTGGTTTTTTTTTTGTACTCGTGGGGTT
TTAAGCCCAACTTGATAATTCATGTGAACTTCTCAATCTAAGTTTAAATT
AAGCTGTGAATGATCCTTGTTTGTTTTTTTTTTTGCTTACCGATGGACTC
AAAGGTAGTTTGGGTACATAATGGATTAATATTGTGGGGTTTGAGTTATA
GGTTAATTTAGTTGTTGTGGGTCTCAGGCCCAAGTTAATAATCACCTTGT
ATTTGCATTTTTATATATTGGATTCAATTGTGGGATCTTATTGATGCTAA
GCGACTTTTTTCTTTATTAGGAATATTGTTTCTTGTTTTTTAAAAATAAA
GATGGTTGTGTAACCGTCAATTTAAGCGAGTAAAAACTCTTACACCCATC
TTTTAATGAAAAATTTTGTTTTTACCAATTTAATTCAGACTTTTAATTTA
CACTATCTTTGTATTAGTGTAGGCTCCAAGATTAGAATTAGTAGTTGTAT
TTATAGATGTATTGATTGGTCATTGACTAAATTGGATTAGTCATTACTTG
TTATTAATTTAATTATATATAAATTACGATTCTGTTAGTGTGTGAAATTT
CTTTTCTTTGATTTTATTCATTGCAGATTCTTGAAACATATTAAATCTAT
TTTGTTCTTGTTCCTTCTTTATATAATGATGTAAGCTCCATTGGAGCTTG
TAGGCCTAGGAAGATGAATGACAGCGGAATGGAGAAGGAAAAGAGAAAGA
AGATGCCACTTCAAGGAGAAGATGAGTCTAGAAGAAGCTCACAACCATAG
GAGGCCATGGATAAGAGCTTGGAGGAAGAAAGAGATGAATGAAGGGAGAG
GAAGAGAAGAGCACAAAATTTTTGTGCTCTAAAAGAGCTCTGAAATCTGA
AGTTTAATTTTCAAATGATCAAAGTTAAAAAAATGCACACACACATGACCTC
TATTTATAGCCCAAGTGTCACACAAAATTGGAGGGAAATTCAAATTTCAC
TTGAATTTATGGAGCCAAATTTTGGAGCCAAAACTTCACTAATTATAATT
AGTGAATTGCAGTTATGGTTCAGCCCACTAATCCAAGATCAATTCCAAGA
TTCGCCACTAATTGTGCTTAGGTGTCATGAGGCATGTAAAGCATGAAGGA
CATGCACAAAGTATGACTATATGATGTGGCAATGGGGTGTAGTAAGCAAA
TGCTCACCTCCCCCTCTAAAATTTAATTGGATTGGGCTTCTACCAATTCA
ATTAAATTTATTTCTCAACACACACATCAAATATTCACTTAGTGAATGTG
AAATTACAAAACTACCCATAATACAAAAACTAGTCTAGGTGCCATAAAAT
ACAAGGGTTGAAAAATCCTATATTTCTAGGGTATCCTACCTACATTATGG
AGCCCTAAATACAAGGACCAAGTATAATGACATCCTAATCTAATATGTAC
AAAGATAATTGGACCCAACCTTGGCCCATGGGCTCAGAAATCTACCTTAA
GGTTCATGAGAACCCTAGGGCCTTCTTCAGCAGCTCTAGCCCAATCCTCT
TGGAGCCTCTTGCTCATGGCTCTAGTGACTGGTCCCTTCCTAGGGAGGAT
TGCATCATTCCCTCCCCCTTGAAGAGGATTTGACCTTAAATCTGTTAGTT
CCTCCTCCTCAATATCAGCTCCACCTTCAAAAGGAATTAAATCAAAAATG
TTAAAAGTGGTGTTGACTCCATACTCTTCTAGGAGGTCCAACCTATAGGC
ATTGTTATTGATCCTCTCCAAAACCTGGAAAGGTCCATCCCCTCTAGGGC
TAAGCTTGAGTATTCTATAGTGTCACCTAAATAGCTTGGC

*RPS-1*-κ NUCLEOTIDE SEQUENCE AND PROTEINS

CROSS-REFERENCE TO RELATED APPLICATIONS

This application is a Continuation-in-Part of U.S. Ser. No. 10/909,950 filed Aug. 2, 2004, now U.S. Pat. No. 7,256,323, which is a conversion of U.S. Provisional Application No. 60/492,169, filed Aug. 1, 2003, herein incorporated by reference in its entirety.

GRANT REFERENCE

This invention was made with government support under United States Government, USDA/CSREES Contracts 2002-31100-06019, 2001-31100-06019, and 2001-35301-10577. The Government has certain rights in the invention.

FIELD OF THE INVENTION

This invention relates to the purified and isolated family of Rps1-k disease resistance genes, proteins encoded thereby and use of the same to confer, enhance or otherwise modify resistance of soybean to plant pathogens, particularly *Phytophthora sojae.*

BACKGROUND OF THE INVENTION

Soybean [*Glycine max* L. (Merrill)] is a major oil seed crop and is grown throughout much of the world. The United States alone produces over half of the world output. Soybean seed typically contains 40% protein and 20% oil and is used primarily for livestock feed and industrial purposes, in addition to human consumption. In North America, soybean suffers yield loss from the root and stem rot disease caused by oomycete pathogen *Phytophthora sojae*. In the United States the annual crop losses from this disease were valued to about 0.2-0.3 billion dollars (Wrather et al. 2001). Plant resistance to this and other sort of pathogens present a major problem to soybean growers.

Plant do not have circulatory or any auto-immune systems that are integral parts of mammalian defenses to pathogens and instead have evolved unique defense mechanisms to defeat invading pathogenic organisms. Plants rely primarily on active defense mechanisms to combat and resist damage from invading pathogens. These defense mechanisms are regulated by single race-specific disease resistance (R) genes that encode receptors to recognize specific pathogen derived ligand molecules (Dangl and Jones 2001). The genetic basis of this recognition phenomenon was described by Flor as a 'gene for gene' relationship in the flax and *Melampsora lini* interaction (Flor 1955). In recent years over 30 R genes have been isolated (Dangl and Jones 2001; Hulbert et al. 2001). Cloning of resistance genes and their corresponding avirulence genes has facilitated the demonstration of the in vivo interactions between products of resistance and avirulence genes as a proof for the Flor's hypothesis (Leister et al. 1996; Scofield et al. 1996; Tang et al. 1996 2000).

Several plant disease resistance genes that follow the classical gene-for-gene hypothesis (Flor, 1955) have been cloned. These genes can be classified into four major groups based on the structures of their protein products: i) proteins with serine/threonine kinase activity, e.g., Pto (Martin et al., 1993); ii) proteins with nucleotide binding sites (NBS) and leucine rich repeat regions (LRR), e.g. RPS2, N, L6, RPM1, Prf, M, I2 and RPP5 (Anderson et al., 1997; Bent et al. 1994; Grant et al., 1995; Lawrence et al., 1995; Mindrinos et al., 1994; Ori et al., 1997; Parker et al., 1997; Salmeron et al., 1996; Whitham et al., 1994); iii) proteins with leucine rich repeat regions and transmembrane domain, e.g. Cf2, Cf4, Cf5, Cf9, and Hs1$^{pro-1}$ (Cai et al., 1997; Dixon et al., 1996; Jones et al., 1994; Thomas et al., 1997) and iv) proteins with leucine rich repeat regions, transmembrane and serine/threonine kinase domains, e.g. Xa21 (Song et al., 1995). The group carrying genes with NBS and LRR motifs can be sub-divided into two sub-groups. They are: iia) TIR NBS-LRR genes that carry an N-terminal TIR domain with homologies to Toll receptor of *Drosophila* and interleukin-1R receptor of mammals, and iib) non-TIR NBS-LRR genes that carry no TIR domain (Meyers et al., 1999). Most of the disease resistance genes cloned recently belongs to non-TIR group, which includes genes that confer resistance to viruses, bacteria, fungi, oomycetes, nematodes and aphids. TIR NBS-LRR type genes are most likely absent in the Poaceae (Meyers et al., 1999; Pan et al., 2000). Meyers and co-workers (1999) concluded that *Arabidopsis* genome contains approximately 200 genes that encode NBS sequences and are located in 21 genomic clusters and 14 isolated loci. Structural conservation among resistance genes from a wide range of plant species prompted several groups to identify putative resistance genes from *Arabidopsis*, potato, rice, soybean and wheat (Botella et al., 1997; Kanazin et al., 1996; Leister et al., 1998; Leister et al., 1996a; Yu et al., 1996).

Rps (Resistance *Phytophthora sojae*) loci have provided a reasonable protection to soybean crops against *Phytophthora sojae* over the last three decades. There are several physiological races of this fungal pathogen. The number of races is increasing rapidly. For example, in 1994 there were 37 recorded races of the fungus (Förster et al., 1994). Now the number is 45 (Abney et al., 1997). Schmitthenner and his co-workers (1994) concluded that *P. sojae* is a highly variable pathogen and exists in soil as a wide variety of virulence phenotypes to which most Rps genes are ineffective. They also concluded that, unless new Rps genes are identified or existing Rps genes are pyramided in single cultivars, resistance available in the present day cultivars might not be effective in controlling the disease in future.

At present, there are 14 Rps genes that confer race-specific resistance of soybean to different physiological races of *P. sojae*. These genes were obtained from different *Glycine max* lines, and mapped to eight loci (Anderson and Buzzell, 1992; Polzin et al., 1994; Schmitthenner, 1989; Burnham et al. 2003). Of these 14 genes, five are mapped to Rps1 and three to Rps3. The genetics of resistance conferred by Rps genes is well established. Recently, genetics of most of the avirulence genes (Avr) that correspond to specific Rps genes have also been reported (Gijzen et al. 1996; Tyler et al., 1995; Whisson et al., 1994; 1995). The interactions between these 14 Rps genes with the corresponding genes for avirulence in *P. sojae* follow the 'gene-for-gene' hypothesis (Flor, 1955).

To date no soybean resistance gene has been cloned. Lack of these genes has limited the progress towards understanding the signal transduction process involved in the expression of race-specific resistance in soybean. Isolation of this gene will allow us to investigate the mechanism of stable resistance governed by this most extensively used gene.

BRIEF SUMMARY OF THE INVENTION

In one aspect, this invention relates to the family of Rps1-k DNA sequences isolated from soybean (*Glycine max*). Also according to the invention protein sequences are disclosed which are encoded by this family of DNA sequences. These DNA sequences have been found to be highly conserved with 93% to 100% sequence identity and 89.9%-100% identity at the amino acid level. These sequences alone, or in combination with other sequences, can be used to improve the soybean resistance to fungal pathogens such as *Phytophthora*. In another aspect of the present invention, expression cassettes and transformation vectors comprising the isolated nucleotide sequences are disclosed. The transformation vectors can be used to transform plants and express these pathogen control genes in the transformed cells. Further, areas of highly conserved structural regions of these proteins are disclosed which are present throughout the Rps1-k family of genes are disclosed which support that a common signal pathway is involved in mediating resistance in soybean against a diverse group of pathogens including oomycetes, bacteria, ciruses, and nematodes and thus these conserved areas may be used to engineer broad spectrum pathogen resistance. Transformed cells as well as regenerated transgenic plants and seeds containing and expressing the isolated DNA sequences and protein products are also provided.

Therefore, in one aspect, the present invention relates to an isolated nucleic acid comprising an isolated polynucleotide sequence encoding a Rps1-k gene product. In a further aspect, the present invention includes a nucleic acid selected from: (a) an isolated polynucleotide encoding a polypeptide of the present invention; (b) a polynucleotide having at least 90% or 95% identity to a polynucleotide of the present invention; (c) a polynucleotide comprising at least 50 or more nucleotides in length which hybridizes under high stringency conditions to a polynucleotide of the present invention; (d) a polynucleotide comprising a polynucleotide of the present invention; and (e) a polynucleotide which is complementary to the polynucleotide of (a) to (e). The invention also relates a polynucleotide which encodes a series of conserved structural motifs known to be associated with pathogen resistance and found to be present in all Rps1-k family members.

In another aspect, the present invention relates to a recombinant expression cassette comprising a nucleic acid as described, supra. Additionally, the present invention relates to a vector containing the recombinant expression cassette. Further, the vector containing the recombinant expression cassette can facilitate the transcription and translation of the nucleic acid in a host cell. The present invention also relates to host cells able to express the polynucleotide of the present invention. A number of host cells could be used, such as but not limited to, microbial, mammalian, plant, or insect. Thus the invention is also directed to transgenic cells, containing the nucleic acids of the present invention as well as cells, plants, tissue cultures and ultimately lines derived therefrom.

This invention also provides an isolated polypeptide comprising (a) a polypeptide comprising at least 90% or 95% sequence identity to a polypeptide of the present invention (b) a polypeptide encoded by a nucleic acid of the present invention; and (c) a polypeptide comprising Rps1-k activity and comprising the conserved structural domain motifs of the invention.

Another embodiment of the subject invention comprises a methods for engineering broad spectrum pathogen resistance in soybean plants using Rps1-k proteins against *Phytophthora* and other soybean pathogens by elucidating the pathways that regulate gene transcription involved in enhancing accumulation of products shown to be associated with expression of pathogen resistance, methods for providing for increased non specific resistance to particularly virulent races or strains of pathogenic agents including *P. sojae, Pseudomonas syringae* pv. *glycenia* (Psg), soybean cyst nematode (SCN), or soybean mosaic virus.

Nucleotide sequences isolated from the Rps1-k locus including the Rps1-k gene family can be used in developing perfect molecular markers that can be routinely used in breeding programs for incorporating Rps1-k and four other functional Rps1 genes such as Rps1-a, -b, -c and -d into new soybean cultivars.

The Rps1-k gene family will pave the way for better understanding the mechanism of *Phytophthora* resistance and also for isolating other important proteins involved in the expression of resistance, and thereby, this invention will lead to the development of a strong background for genetic engineering of soybean for disease resistance.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Figure 6:
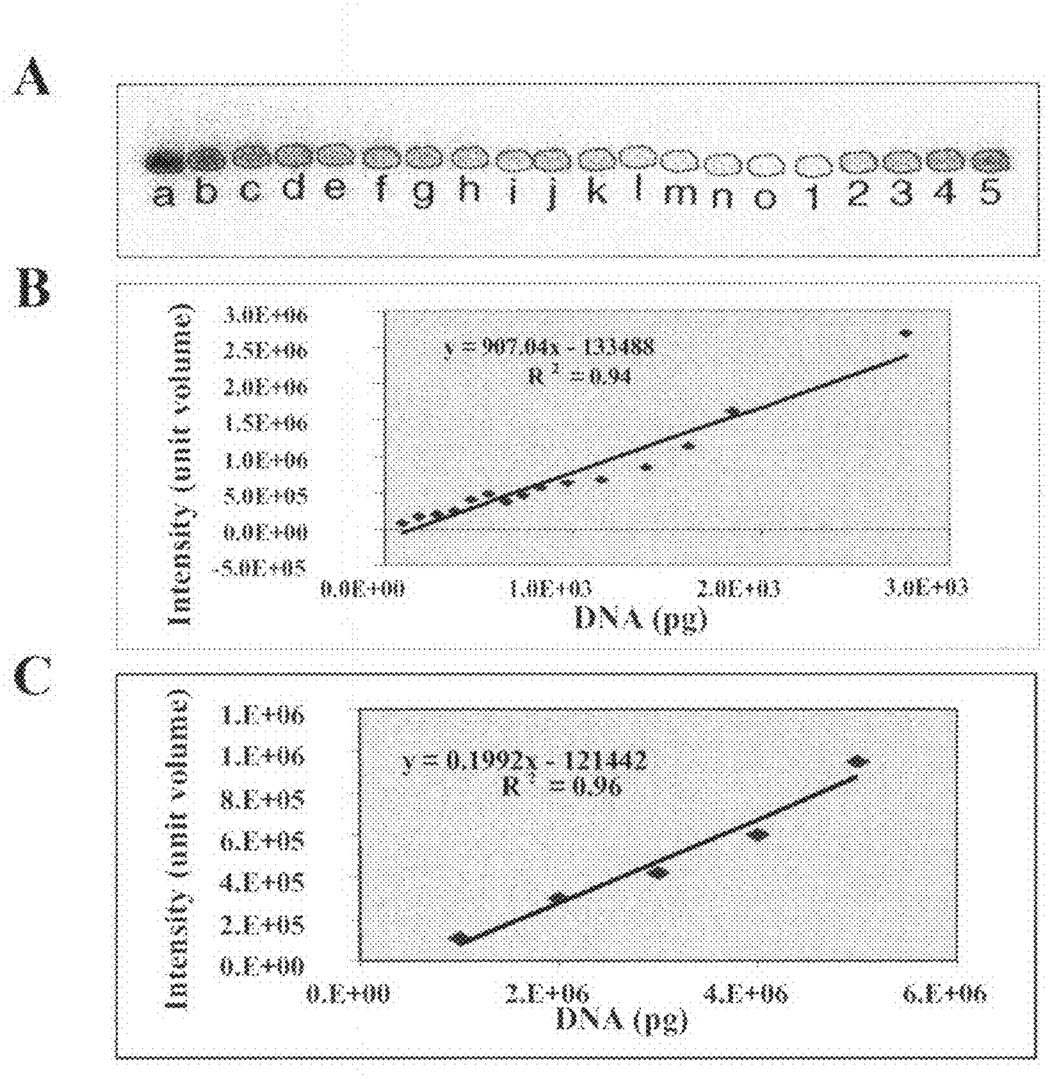

FIG. 6. Copy number of the LRR sequences. (A) Phosphoimage of a Southern blot carrying HindIII digested plasmid pGO2 DNA (a, 5,700 pg; b, 3,800 pg; c, 3,325 pg; d, 2,850 pg; e, 2,375 pg; f, 1,990 pg; g, 1,710 pg; h, 1,520 pg; I, 1,330 pg; j, 1,140 pg; k, 950 pg; l, 760 pg; m, 570 pg; n, 380 pg; o, 190 pg) and soybean genomic DNA (1, 1 μg; 2, 2 Hg; 3, 3 μg; 4, 4 μg; and 5, 5 μg) samples hybridized to pGO2-specific LRR sequence. (B) Linear relationship between intensity of hybridization signals (volume) and adjusted concentration of pGO2 DNA content. Values shown in A are adjusted by subtracting the DNA contents for the 9.1 kb pTF101.1 vector. For example, adjusted values for a, b and o are 2770, 1847 and 92 pg, respectively. (C) Linear relationship between intensity of hybridization signals (volume) and concentrations of soybean genomic DNA in picograms.

Figure 7:
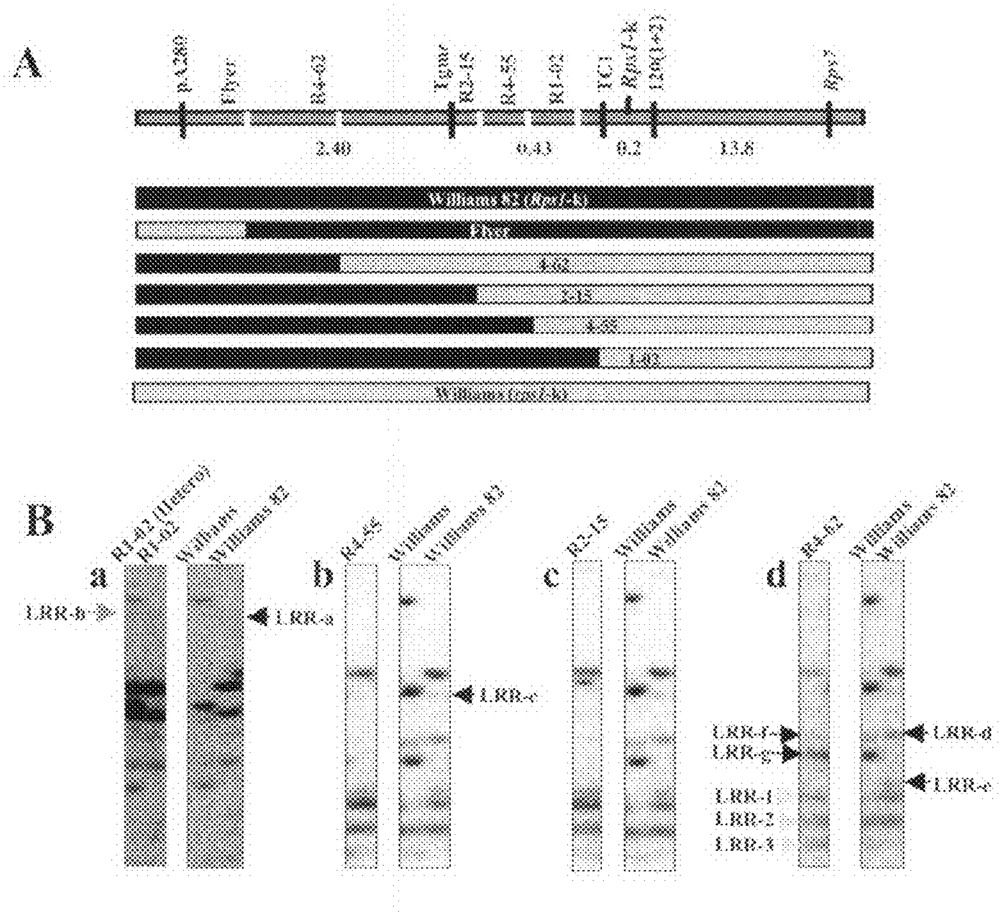
Figure 7:
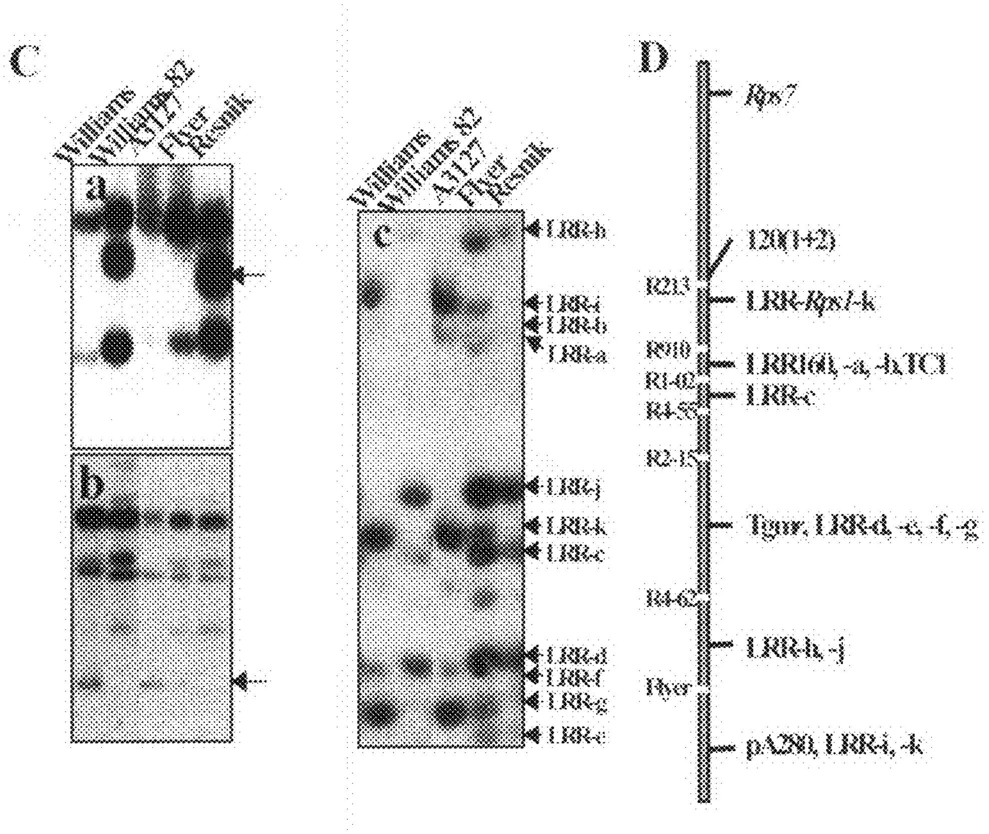

FIG. 7. Mapping of the LRR sequences using near-isogenic lines. (A) Genotype of NILs used in mapping LRR160 are shown against a genetic map of the Rps1-k region. Dark lines represent DNA from the introgressed region carrying Rps1-k. Faint lines represent the DNA from susceptible lines. (B) Southern blot of TaqI digested genomic DNA was hybridized to the pGO2-specific LRR probe and arrows are used to show the LRR sequences mapped to different loci shown in FIG. 7D. Arrows show the Williams 82-specific fragments that disappeared in the recombinant lines due to exchange of DNA strands between parents. For example, the LRR-a fragment is missing from all recombinant lines except R910 or R213 (data not presented). Therefore, this locus was mapped in between recombination break points of R910 and R1-02. In the first panel a heterozygote R1-02 recombinant genotype (R1-02{Hetero}) is included to show that this recombinant received the Williams-specific fragment LRR-b not the LRR-a, which is slightly smaller than LRR-b. LRR-c is missing in all recombinants except in R1-02 (FIGS. 7B-*a*), R910 and R213. Therefore, the LRR-c locus mapped in between the breakpoints of R-02 and R4-55. LRR-d and -e are missing in R4-62, and instead, two Williams-specific fragments LRR-e and -f were observed in this recombinant. Therefore, these fragments were mapped in between breakpoints of R2-15 and R4-62. LRR1, -2, and -3 are mnomorphic and could not be mapped. DraI-digested DNA revealed that the Williams 82-specific pA280 allele (shown by arrow in FIGS. 7C-*a*) is missing in Flyer, therefore, this line carries a breakpoint between Tgmr and pA280. Flyer carries all the LRR sequences. observed in Resnik and a fragment-specific to A3127 (shown by arrows in FIGS. 7C-*b*). TaqI-digested DNA (FIGS. 7C-*c*) supported the results observed for DraI digested DNA that was probed with the LRR probe (FIGS. 7C-*b*). Flyer carries two A3127 (recurrent parent)-specific TaqI fragments LRR-i and -k in addition to all LRR sequences from the donor parent Williams 82 (FIGS. 7C-*c*). LRR sequences specific to A3127 observed in Flyer but not in Resnik were mapped to the pA280 locus tentatively. These sequences can, however, be mapped to a locus (loci), south of pA280. Polymorphic fragments LRR-h and -j-specific to Williams 82 were found in Flyer and also in R213 that does not carry any Williams 82 specific DNA beyond CG1 {breakpoint between CG1 and 120(1+2)}. These sequences were also found in other recombinants. Therefore, these were mapped between breakpoints of Flyer and R4-62.

FIG. 8. Alignment of informative polymorphic sites among members of the Rps1-k gene family. (A) IPSs and deletions of 5'-end regions. The nucleotide sequence of Rps1-k1 is as set forth in SEQ ID NO:146 and the nucleotide sequences of Rps1-k2 and Rps1-k4 are identical as set forth in SEQ ID NO:147. (B) IPS and deletions among ORFs. The nucleotide sequence of Rps1-k1 is as set forth in SEQ ID NO:148 and the nucleotide sequences of Rps1-k2 and Rps1-k4 are identical as set forth in SEQ ID NO:149. (C) IPSs and deletions of 3'-end regions. The Sequence Output for DOS, Version 2.0, was used for this analysis (B. G. Spratt, University of Sussex, Brighton, UK). The nucleotide sequences of Rps1-k5 and Rps1-k3 are as set forth in SEQ ID NO:150-151 respectively. The nucleotide sequences of Rps1-k2 and Rps1-k4 are identical as set forth in SEQ ID NO:152.

Figure 9:
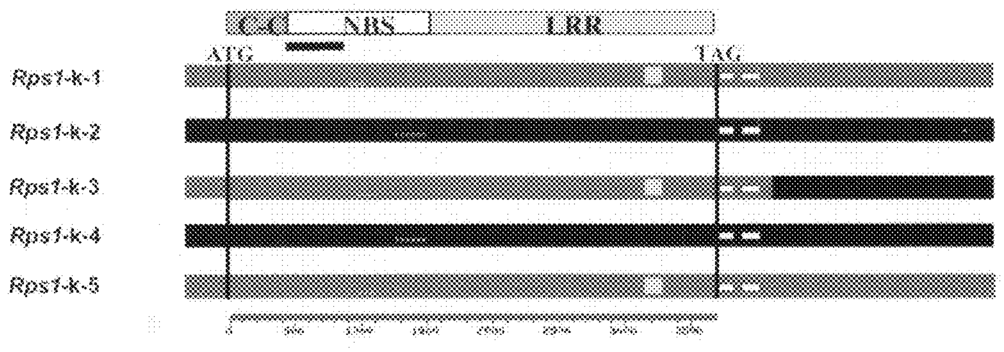

FIG. 9. The Rps1-k gene family comprising two classes of identical genes. In developing this figure, informative polymorphic sites (IPSs) were used to trace the lineages of individual genes. Red and black colors show the lineages of members of the gene family. Rps1-k-1 and -5 are identical genes that were cloned from nonoverlapping BAC18 and BAC99. Rps1-k-3 is distinguished from Rps1-k-1 and -5 by a recombination breakpoint between nts 302 and 478 from the stop codon. Rps1-k-2 and -4 are identical except for a single nt deletion at position 1900 from the stop codon. ■, the conserved nucleotide binding site; *, deletion of an nt; , deletion of 63 nts; □, two introns of 142 and 152 nts, respectively.

FIG. 10. Amino acid sequence comparison between Rps1-k-2 and Rps1-k-3. The predicted amino acid sequence of Rps1-k-2 is shown under domains A to F, indicating differences between the two protein sequences. The myristylation site in domain A is underlined. The coiled-coil domain is in domain B. The prediction was performed by COILS (Lupas, 1997). The conserved P loop as well as kinase-2 and kinase-3a sequences in NBS are underlined. The LRR alignment is shown in domain E. The consensus sequence in LRRs is indicated by xxLxLxx (SEQ ID NO:140) in the line above the alignment of LRRs (L can be replaced by V, F or M). The leucine-zipper-like motif is shown in bold. Domain F is the C-terminus. The red-highlighted residues are the sites that vary between Rps1-k-2 and Rps1-k-3. One LRR repeat of 21 amino acids was deleted from Rps1-k-3 and is shown by green color in Rps1-k-2.

Figure 11:
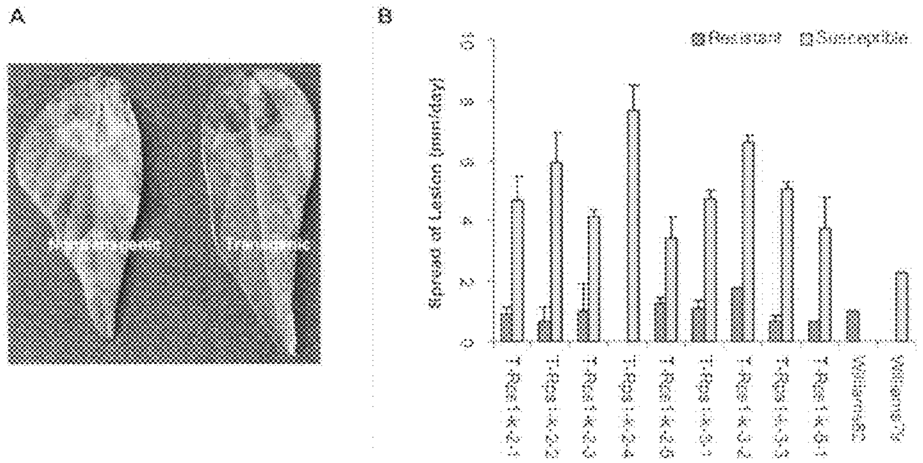

FIG. 11. The complementation analysis of three genes isolated from the Rps1-k locus. (A) A transgenic $R_0$ leaf shows hypersensitive cell death and typical resistance response. (B) Symptom development among $R_1$ progeny populations. Lesion size was recorded two and three days following inoculation and lesion spread was determined in millimeters per day.

Figure 12:
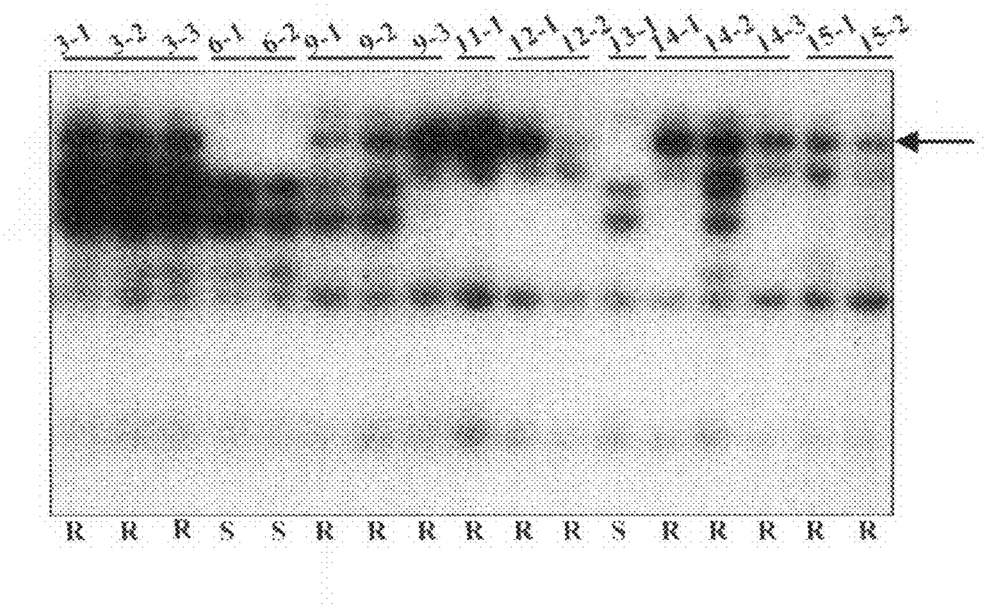

FIG. 12. Co-segregation of an Rps1-k-2 transgene copy with the expression of resistance against *P. sojae* race 4. Etiolated hypocotyls of individual $R_2$ plants from independent $R_1$ progenies were inoculated with the zoospore suspensions and infected seedlings were evaluated 24 h following inoculation (Ward et al. 1979). Phytphthora resistance was co-segregated with a transgene, which is shown by an arrow.

Figure 13:
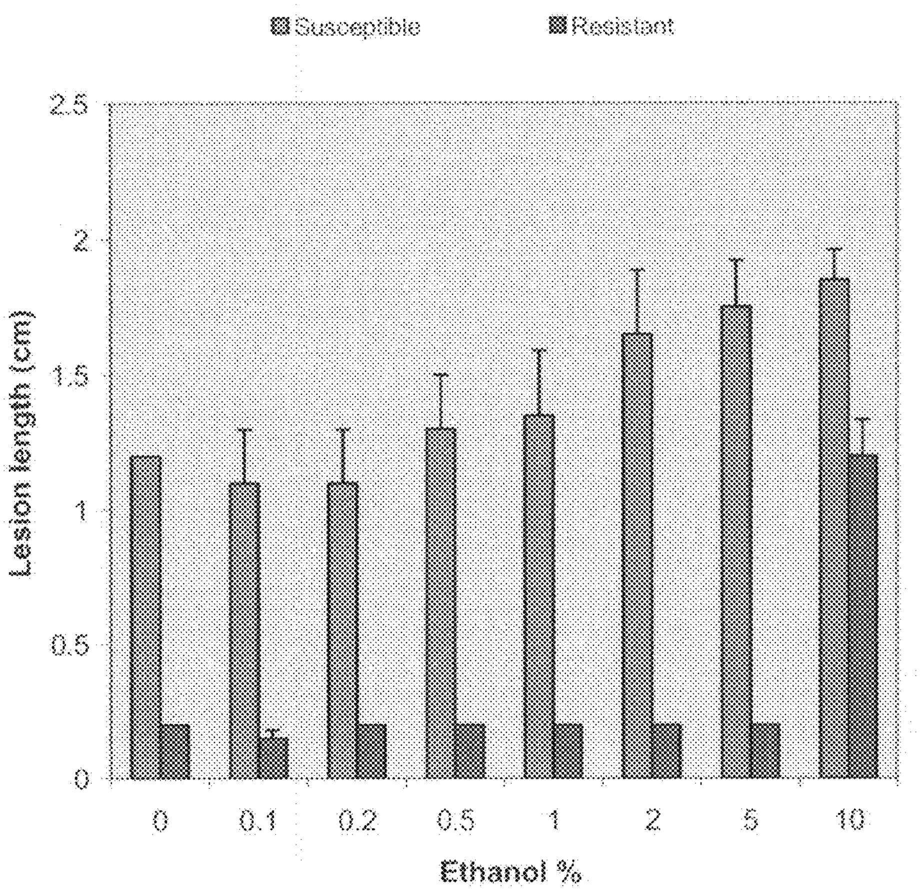
Figure 14:
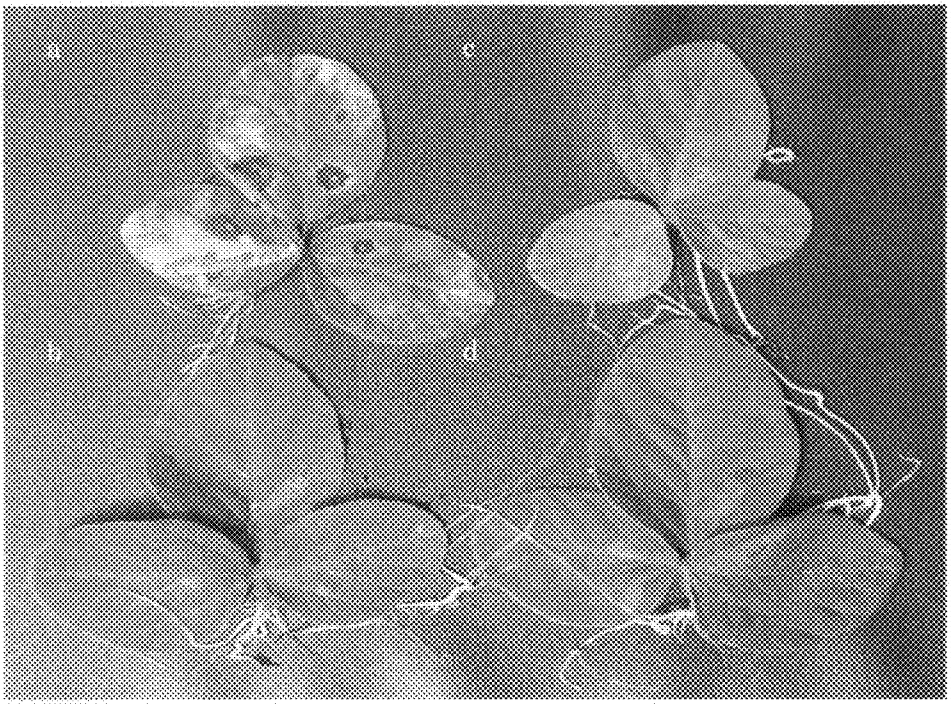

FIG. 13. Lesion development following feeding of soybean seedlings with ethanol. Data were taken 72 h following inoculation. S, Williams inoculated with *P. sojae* race 1;

FIG. 14. Immune responses shown by $R_1$ progenies. a. Williams 82 (Rps1-k) trifoliates showing normal resistant response. b and d, trifoliates from two independent $R_1$ plants of an $R_o$ plant ST20-S1-1-1B carrying Rp1-k-3. c, trifoliates from the $R_o$ plant ST22-S1-37C carrying Rp1-k-2. Arrows are used to show poor HR development among transgenic plants.

Figure 15A:
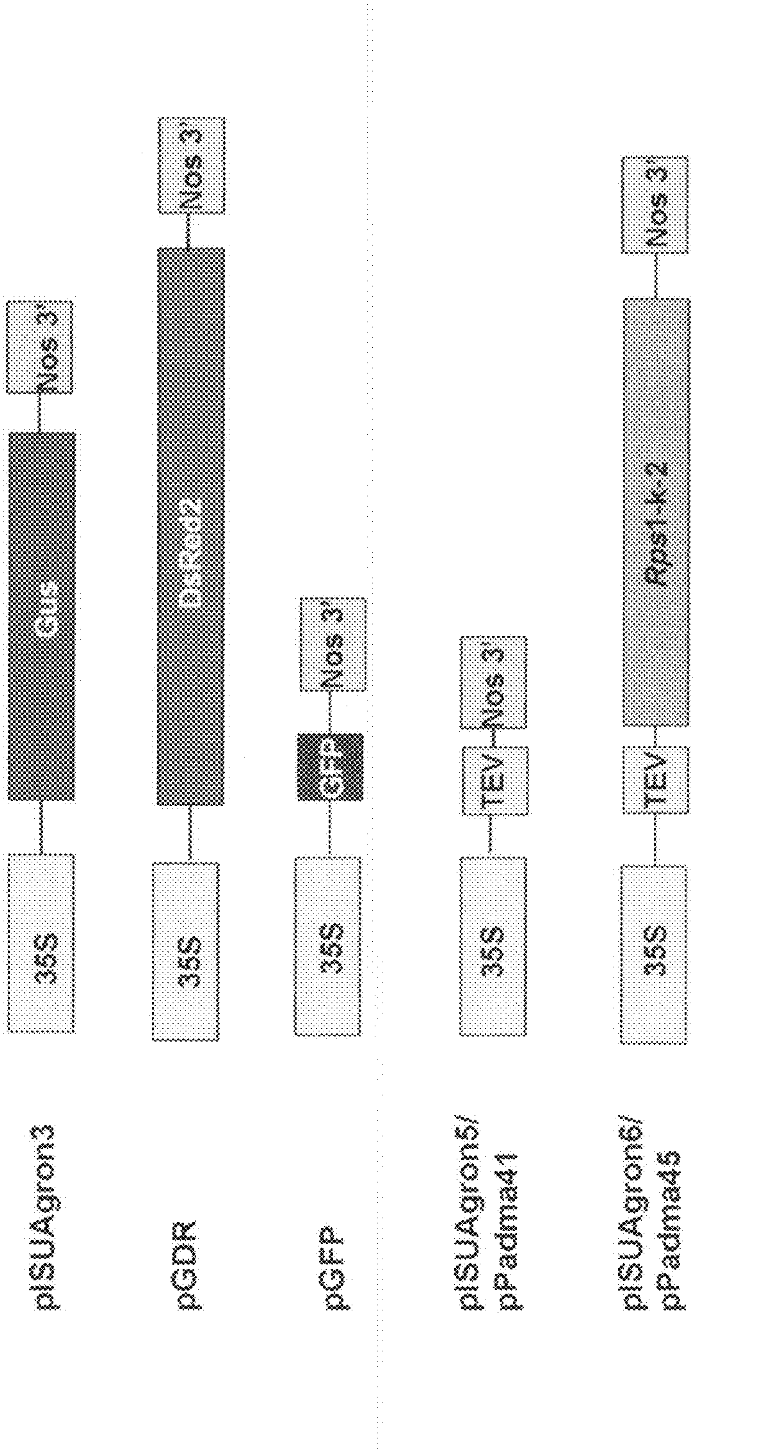

FIG. 15A. Digramatic representations of vectors used in this investigation. 35S, the Cauliflower mosaic virus 35S promoter; GUS, β-glucuronidase; Nos 3',3'-end of the nopaline synthase gene; dsRed2, red fluorescent protein, GFP, green fluorescent protein; TEV-Tobacco etch virus 5'-non-translated region; Rps1-k-2, a *Phytophthora* resistance gene. pISUAgron3, contains the 35S:GUS reporter gene in pTF101.1m vector; pGDR, contains the DsRed2 protein; pGFP, contains GFP; pISUAgron5, empty pTF101.1m-based vector that was used to develop the pISUAgron6 vector containing the 35S:Rps1-k-2 fusion gene; pPadma41, empty Blue Script-based vector that was used to develop pISUAgron6 containing the 35S:Rps1-k-2 fusion gene.

FIG. 15B. Amino acid sequence of the NIB-ARC domain of Rps1-k-2. The residues that were substituted (Table 1) are shown in red bold font.

Figure 16:
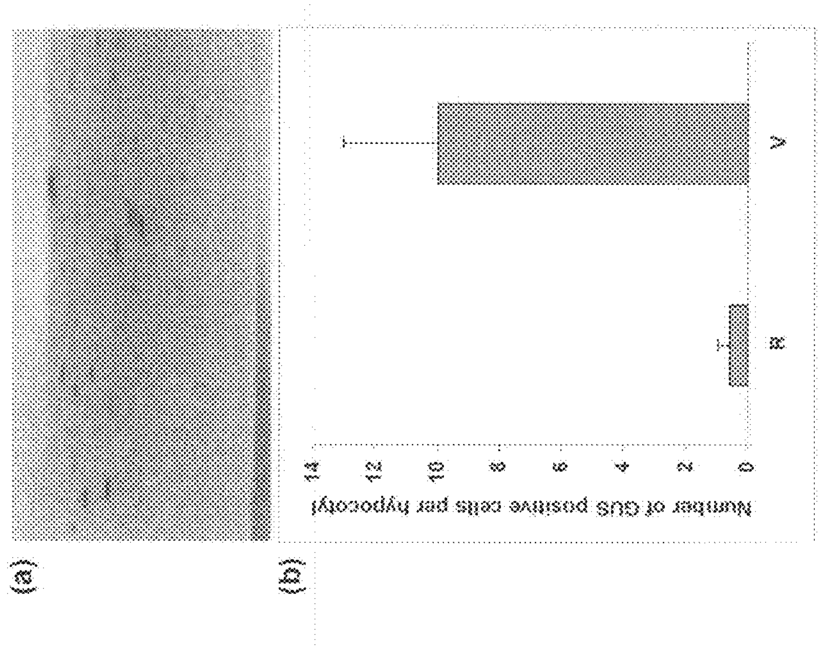

FIG. 16. Transient co-expression of Rps-1-k and GUS Gold particles coated with pISUAgron3 and pISUAgron6 were bombarded onto 8-day old etiolated soybean hypocotyls. Gold particles coated with plasmid pISUAgron3 and the empty vector pISUAgron5 were bombarded separately onto etiolated hypocotyls to serve as the control. (α) Expression of GUS in the soybean hypocotyls co-transformed with the empty binary vector. (b) Number of GUS positive cells/hypocotyl. Results are mean and standard errors from four independent experiments, each of which was replicated 2-5 times (each bar diagram represents mean and standard errors from 13 replications, raw data are presented in Supplementary Table 1). R; co-transformation with pISUAgron6 with pISUAgron3, V; co-transformation of pISUAgron5 with pISUAgron3.

Figure 17:
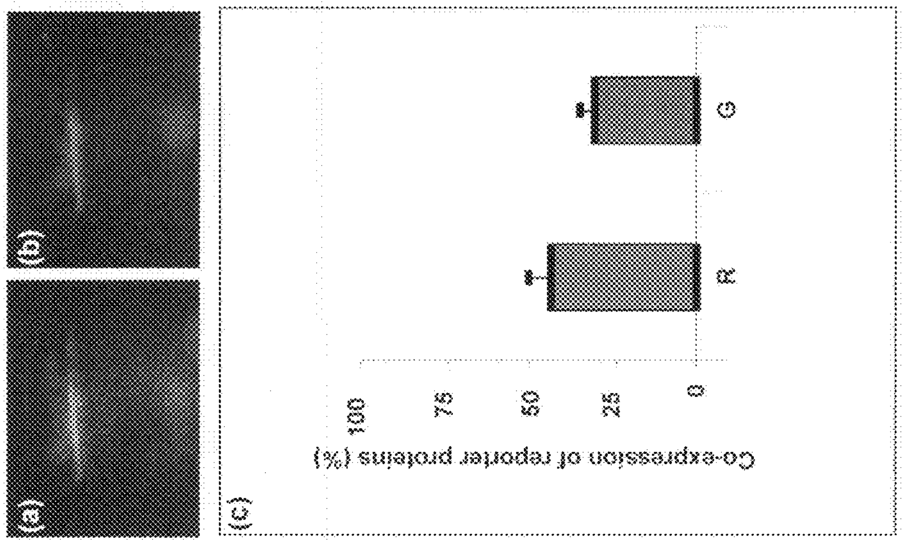

FIG. 17. Transient co-expression of reporter genes. Gold particles coated with pPadma41 (empty vector) and pGFP were mixed with gold particles coated with pPadma41 and pGDR in equal amounts and co-bombarded onto 8-day old etiolated hypocotyls. Expression of GFP and DsRed2 was monitored under α Zeiss Axioplan 2 microscope 24 h following bombardment. (a-b), Epifluorescence micrographs showing the expression of both GFP and DsRed2 in the same cell. (c) Histograms representing average proportions of cells expressing both GFP and DsRed2. R (red bar), represents percentage of cells showing expression of both reporter proteins when expressed over total number of DsRed2 positive cells. G (green bar) represents percentage of cells showing expression of both reporter proteins when expressed over total number of GFP positive cells. Bar diagrams represent means and standard errors calculated from observation of about 20 independent microscopic fields of four hypocotyls. About 200 DsRed2 or GFP positive cells were counted.

Figure 18:
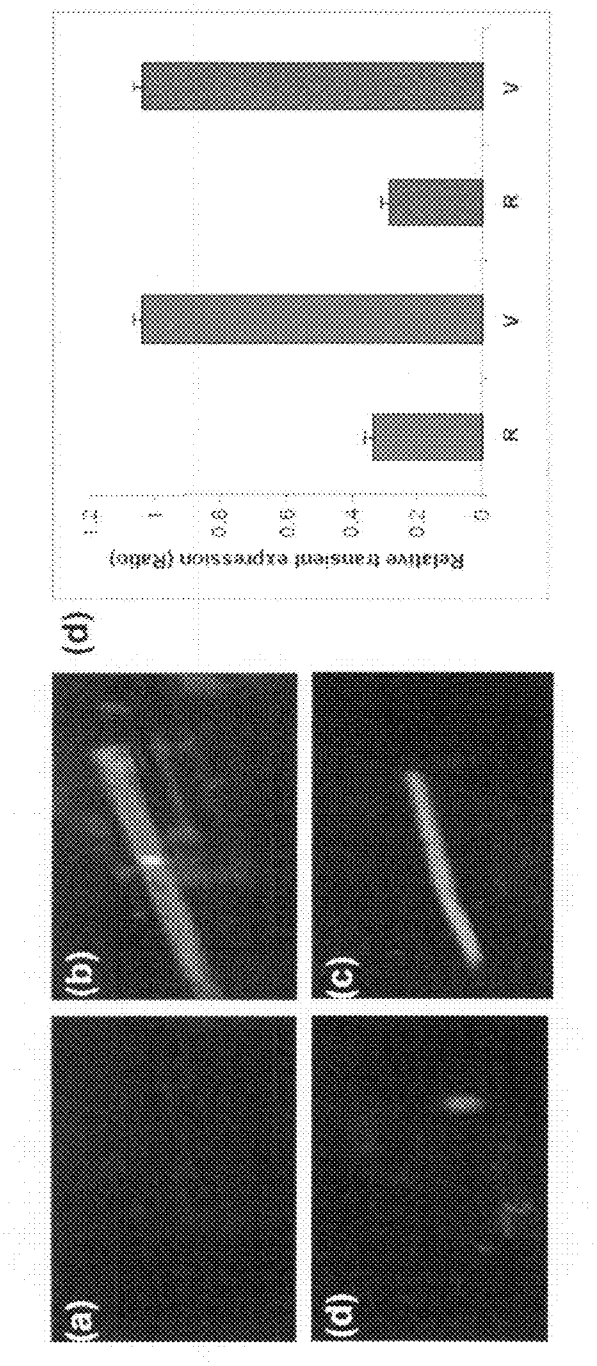

FIG. 18. Rps-1-k-2 inhibits the expression of GFP and DsRed2. Gold particles coated with pPadma45 and pGFP were co-bombarded with gold particles coated with pPadma41 and pGDR onto 8-day old soybean hypocotyls. In the reverse experiment gold particles coated with pPadma45 and pGDR were co-bombarded with gold particles containing pPadma41 and pGFP; and in the negative control gold particles coated with pPadma41 and pGFP were co-bombarded with gold particles coated with pPadma41 and pGDR. (a-b) Epifluorescence micrographs showing transient expression of GFP and DsRed2: (α), pPadma45 and pGFP co-bombarded with pPadma41 and pGDR and visualized for GFP. (b), The same microscopic field shown in (α) was then visualized for DsRed2 expression. Note that expression of DsRed2 but not GFP was detected in a cell of that microscopic field. (c-d), Epifluorescence micrographs showing transient expression of GFP and DsRed2: (c) pPadma45 and pGDR co-bombarded with pPadma41 and pGFP and visualized for DsRed2. (d) The same microscopic field shown in (c) was then visualized for GFP expression. Note that expression of GFP but not DsRed2 was detected in that microscopic field. (h) Results are relative transient expression of α reporter gene from co-transformation with pPadma45 (35S:Rps1-k-2) was calculated as α ratio over that of the other reporter gene co-transformed with pPadma41 (empty vector). R, red bar represents relative expression of DsRed2 (in ratio) from co-transformation with pPadma45 and pGDR over GFP expression levels from co-transformation of pGFP and pPadma41 in the same hypocotyls tissues. Note that both types gold particles were co-bombarded and same microscopic fields were evaluated for DsRed2 and GFP expression. R, green bar represents data of a similar experiment where GFP instead of DsRed2 was co-expressed with 35S:Rps1-k-2, and DsRed2 instead of GFP was co-transformed with the empty vector pPadma41 in the co-bombardment experiments. V, the vector control, in which reporter genes were co-expressed with the empty vector pPadma41. Red bar shows the relative transient expression of DsRed2 protein over GFP and likewise green bar shows the relative expression of GFP over DsRed2 in those negative control experiments. Note that both reporter proteins expressed equally when only empty vector was co-transformed with the either reporter gene in co-bombardment experiments. Results are from two different experiments, each containing two replications. Expression levels of the reporter gene with Rps1-k-2 were expressed as ratios over expression levels of the other reporter gene with the empty vector (internal control) from individual hypocotyls, and ratios calculated from 16 hypocotyls were used to calculate the mean and standard errors.

Figure 19:
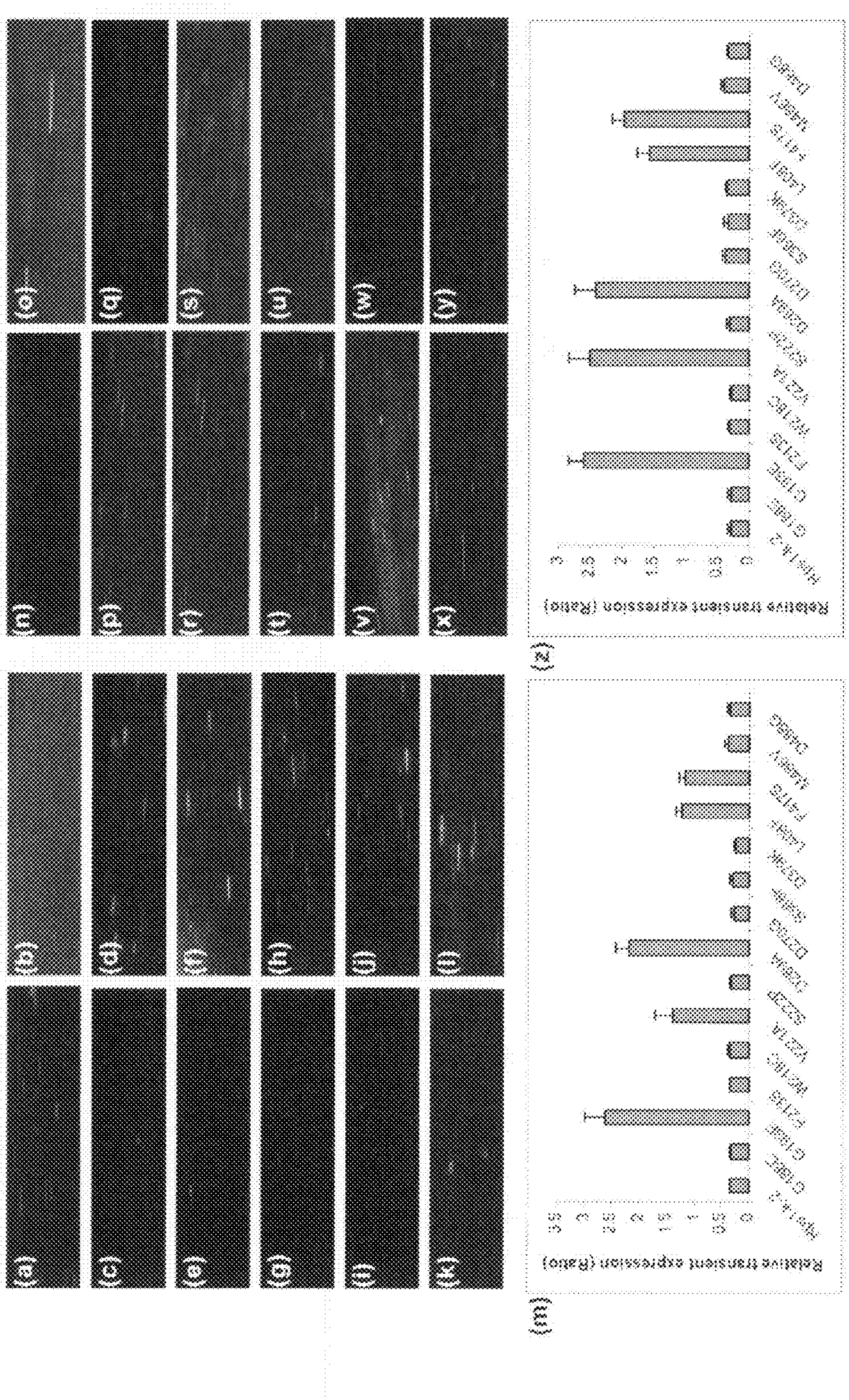

FIG. 19. Identification of amino acids necessary for Rps1-k-2-mediated putative cell death pathway. The reciprocal transient assay system described in FIGS. 3 and 4 was applied in evaluating rpsI-k-2 mutants. (α-1), Epi-fluorescence micrographs of 35S:Rps1-k-2 or 35S:rps1-k-2 mutants co-expressed with DsRed2. With each construct combination gold particles coated with empty vector pPadma41 and pGFP were co-bombarded to serve as an internal control. (a-b), Rps1-k-2; (c-d), mutant G193E; (e-f), mutant V221A; (g-h), mutant D269A; (i j), mutant L408F; (k-1), mutant F417S. (m), Relative transient expression levels (as ratios) of DsRed2, when pGDR was co-transformed with 35S:Rps1-k-2 or 14 35S:rps1-k-2 mutants, over GFP expression levels from the internal control comprising the empty vector pPadma41 and pGFP are presented. (n-y), Epi-fluorescence micrographs of 35S:Rps1-k-2 or 35S:rps1-k-2 mutants co-expressed with GFP. With each construct combination gold particles coated with empty vector pPadma41 and pGDR were co-bombarded to serve as an internal control. (n-o), Rps1-k-2; (p-q), mutant G193E; (r-s), mutant V221A; (t-u), mutant D269A; (v-w), mutant L408F; (x-y), mutant F417S. (z), Relative transient expression levels (as ratios) of GFP, when pGFP was co-transformed with 35S:Rps1-k-2 or 14 35S:rps1-k-2 mutants, over DsRed2 expression levels from the internal control comprising the empty vector pPadma41 and pGDR are presented. Two independent experiments, each containing two replications were conducted. In each replication total GFP or DsRed2 positive cells were counted from four transformed hypocotyls. Total number of positive GFP or DsRed2 cells in an individual hypocotyl was considered to calculate ratios. Bar diagrams represent means and standard errors of ratios from a total of 16 transformed hypocotyls.

Figure 20A:
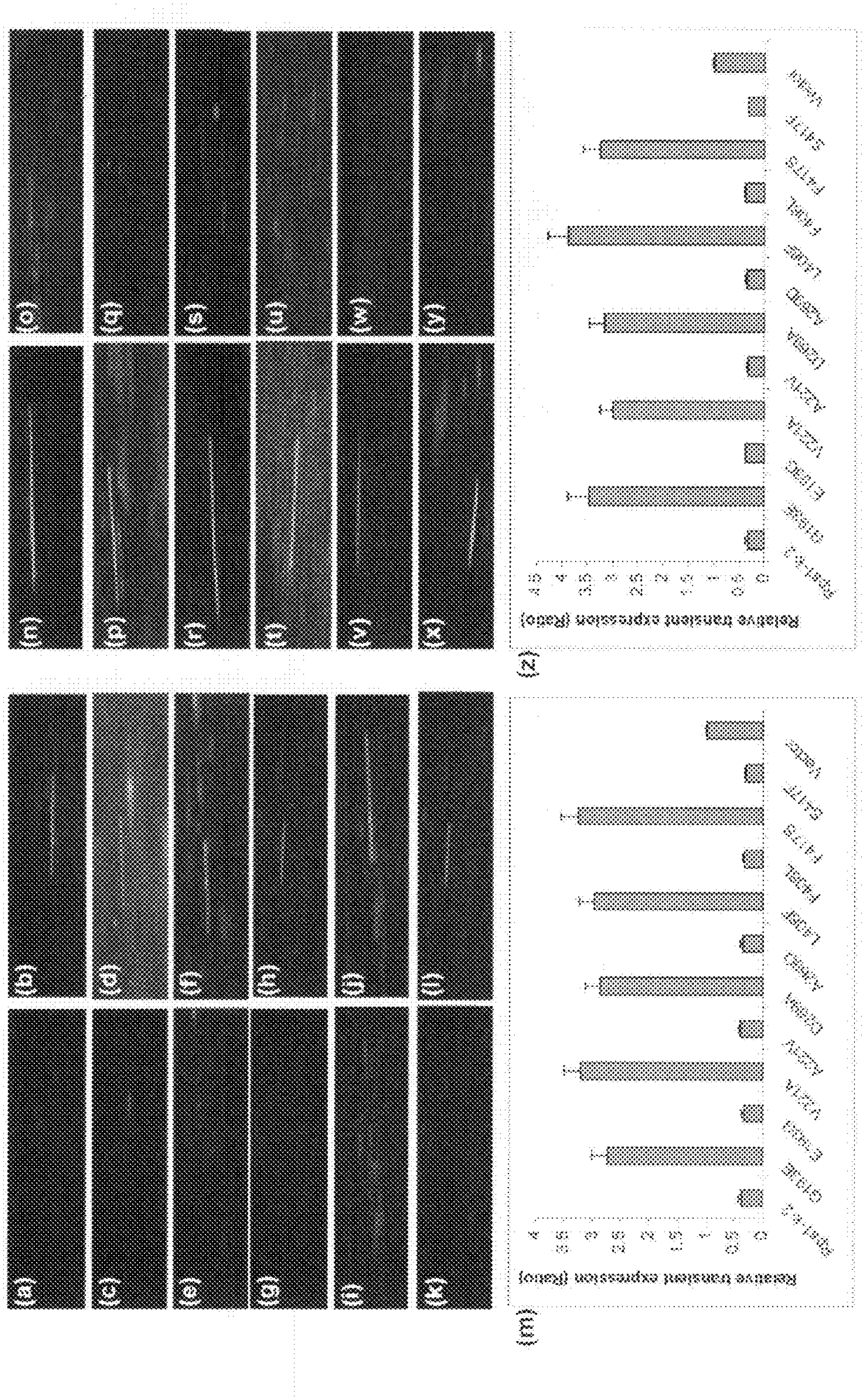

FIG. 20A. Recovery of the Rps1-k-2-mediated putative cell-death phenotype among revertants. The reciprocal transient assay system described in FIGS. 3 and 4 was applied in evaluating revertants of all rps1-k-2 mutants showing loss of putative cell-death function (FIG. 5). (α-1) Epi-fluorescence micrographs of 35S:Rps1-k-2 or revertants co-expressed with GFP and vector pPadma41 co-expressed with DsRed2. (a-b), pPadma45; (c-d), revertant E193G; (e-f), revertant A221V; (g-h), revertant A269D (i j), revertant F408L; (k-1), revertant S417F. (m), Relative transient expression levels (as ratios) of GFP, when pGFP was co-transformed with 35S:Rps1-k-2 or any of the five mutants or their respective revertants, over DsRed2 expression levels from the internal control comprising the empty vector pPadma41 and pGDR are presented. (n-y), Epi-fluorescence micrographs of 35S:Rps1-k-2 or mutants co-expressed with DsRed2 and empty vector pPadma41 with pGFP. (n-o), Rps1-k-2; (p-q), revertant E193G; (r-s), revertant A221V; (t-u), revertant A269D; (v-w), revertant F408L (x-y), revertant S417F. (z), Relative transient expression levels (as ratios) of DsRed2, when pGDR was co-transformed with 35S:Rps1-k-2 or any of the five mutants or their respective revertants, over GFP expression levels from the internal control comprising the empty vector pPadma41 and pGFP are presented. Two independent experiments, each containing two replications were conducted. In each replication total GFP or DsRed2 positive cells were counted from four transformed hypocotyls. Total number of positive cells in an individual hypocotyl was considered for calculating the ratios. Bar diagrams represent means and standard errors of ratios from α total of 16 individual hypocotyls.

Figure 20B:
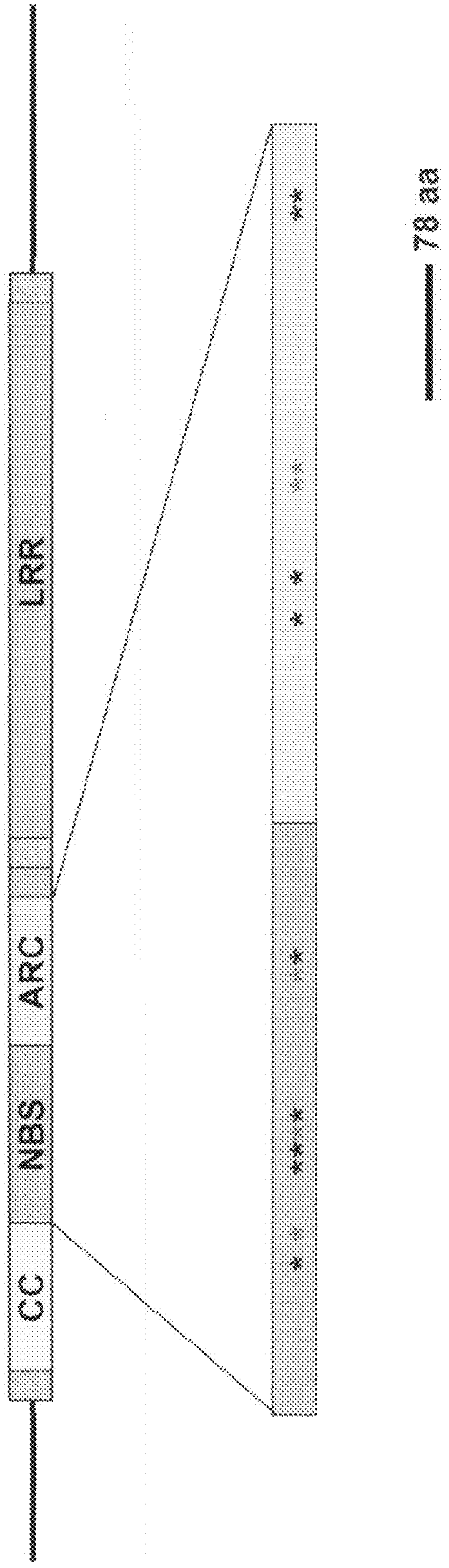

FIG. 20B. Location of five essential amino acids required for the Rps1-k-2-mediated putative cell death pathway. CC, coiled-coil domain; NIB-ARC, α nucleotide binding adaptor shared by APAF-1, certain R proteins and CED-4, and LRR, leucine rich regions. The gray boxes are regions between the conserved domains. Black stars represent the locations of substituted amino acids that did not alter the Rps1-k-2-mediated putative cell death function. Red stars indicate the locations of five amino acids that are essential for the expression of the Rps1-k-2-mediated putative cell death function.

Figure 21:
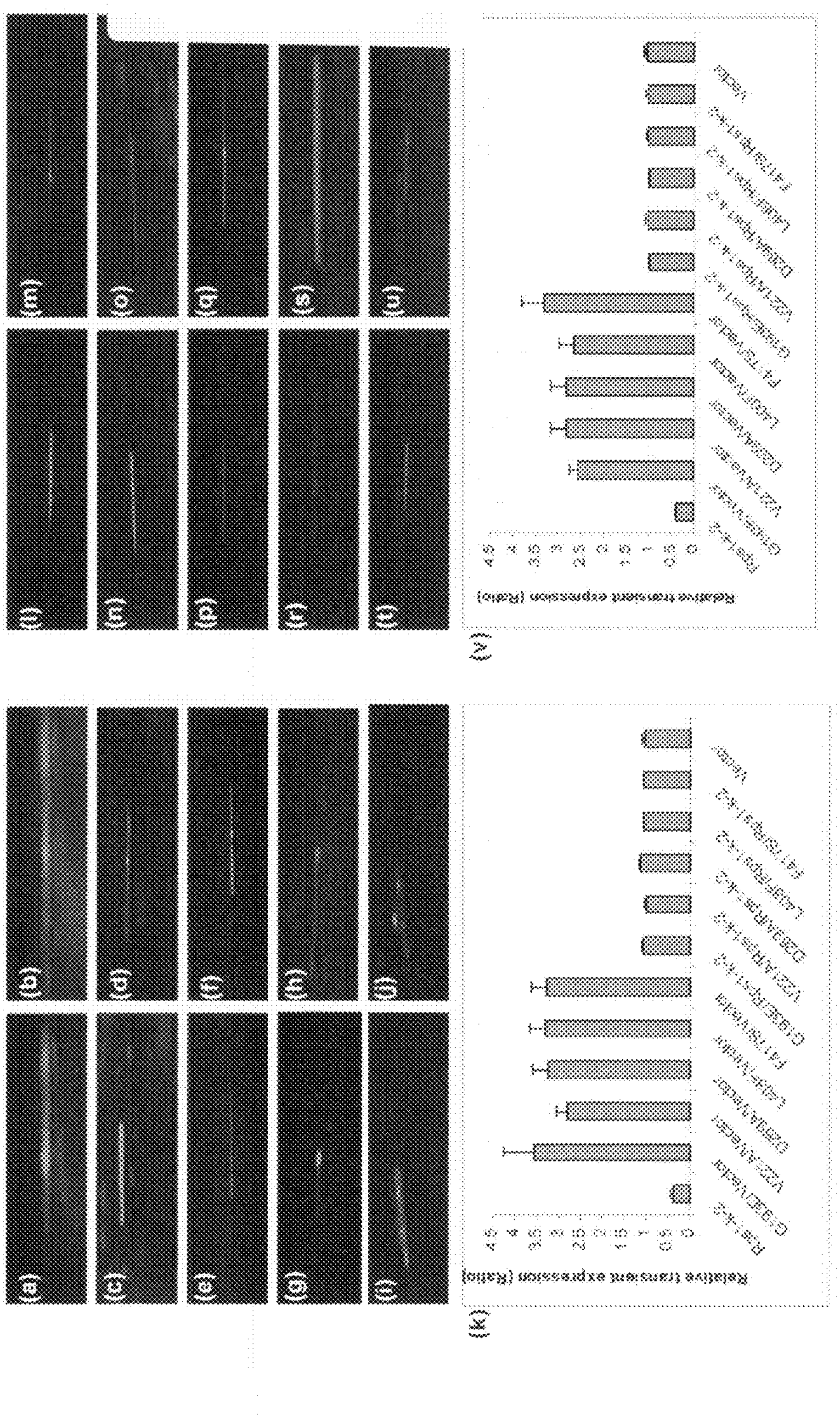

FIG. 21. Rps1-k-2 mediated putative cell death pathway is suppressed by co-expression of rps1-k-2 mutants. 35S:Rps1-k-2 was coated onto gold particles with individual mutants and a reporter gene. Corresponding mutants and the other reporter gene were cobombarded to serve as an internal control. (a-j)) Epi-fluorescence micrographs of 35S:Rps1-k-2 and any of the five mutants co-expressed with GFP. With each combination of 35S:Rps1-k-2 and mutants pPadma41 and pGDR were co-bombarded to serve as an internal control. (a-b), mutant G193E; (c-d), mutant V221A (e-f); D269A (g-h), mutant L408F; (i j), mutant F417S. (k), Relative transient expression levels (as ratios) of GFP, when pGFP was co-transformed with 35S:Rps1-k-2 or any of the five mutants, over DsRed2 expression levels from the internal control comprised of the respective mutant and pGDR are presented. (1-υ) Epi-fluorescence micrographs of 35S:Rps1-k-2 and any one of the five mutants co-expressed with DsRed2. With each combination of 35S:Rps1-k-2 and mutants pPadma41 and pGFP were co-bombarded to serve as an internal control. (1-m), mutant G193E; (n-o), mutant V221A; (P-q), mutant D269A; (r-s), mutant L408F; (t-u), mutant F417S. (v), Relative transient expression levels (as ratios) of DsRed2, when pGDR was co-transformed with 35S:Rps1-k-2 or any of the five mutants, over GFP expression levels from the internal control comprised of the respective mutant and pGFP are presented. Two independent experiments, each containing two replications were conducted. In each replication total GFP or DsRed2 positive cells were counted from four transformed hypocotyls. Total number of GFP or DsRed2 positive cells from individual hypocotyls were used to determine the ratios. Bar diagrams in (k) and (v) represent means and standard errors from a total of 16 hypocotyls.

Figure 22:
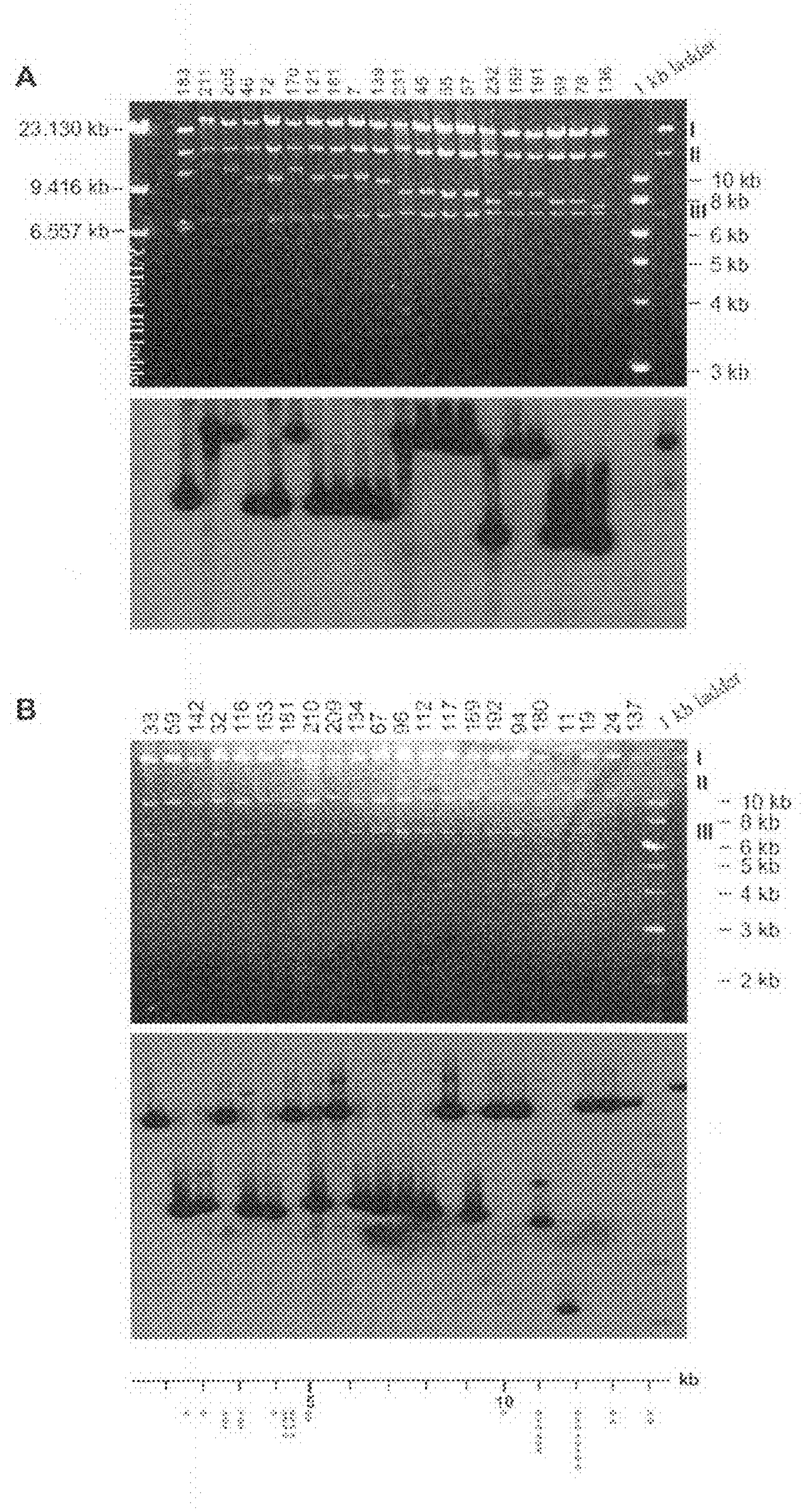

FIG. 22. Physical mapping of the location of EZ::TN <NotI/KAN-3> transposon insertion in a soybean bacterial artificial chromosome. Individual GS_43D16 clones containing the EZ::TN <NotI/KAN-3> transposon were digested with NotI. NotI digestion released three fragments from GS_43D16, Fragment I, II and III, which are shown in the last lane. Note that fragment III is comprised of the pBelloBAC11 vector sequence. A, GS_43D16 clones carrying the transposon in the NotI Fragment I. The top panel showed the gel of NotI digested DNA of a selected set of clones carrying the transposon; the lower panel showed the Southern blot data of the gel shown in the top panel. The probe for Southern analysis was the 411 bp sequence, one end of GS_43D16 that overlaps with GS_99I16. Note that sizes of NotI fragments II and III are same in all the clones. B, GS_43D16 clones carrying the transposon in the NotI Fragment II. The top panel showed the gel of NotI digested DNA of a selected set of clones carrying the transposon; the middle panel showed the Southern blot data of the gel shown in the top panel. The 245 bp probe for Southern analysis was obtained by PCR of the end of GS_43D16 that overlaps with GS_18J19, but not GS_99I16. The lower panel showed the distribution of clones carrying the transposon at various regions of the NotI Fragment II. One dot represented one clone containing the transposon at that particular location of the NotI Fragment II.

Figure 23:
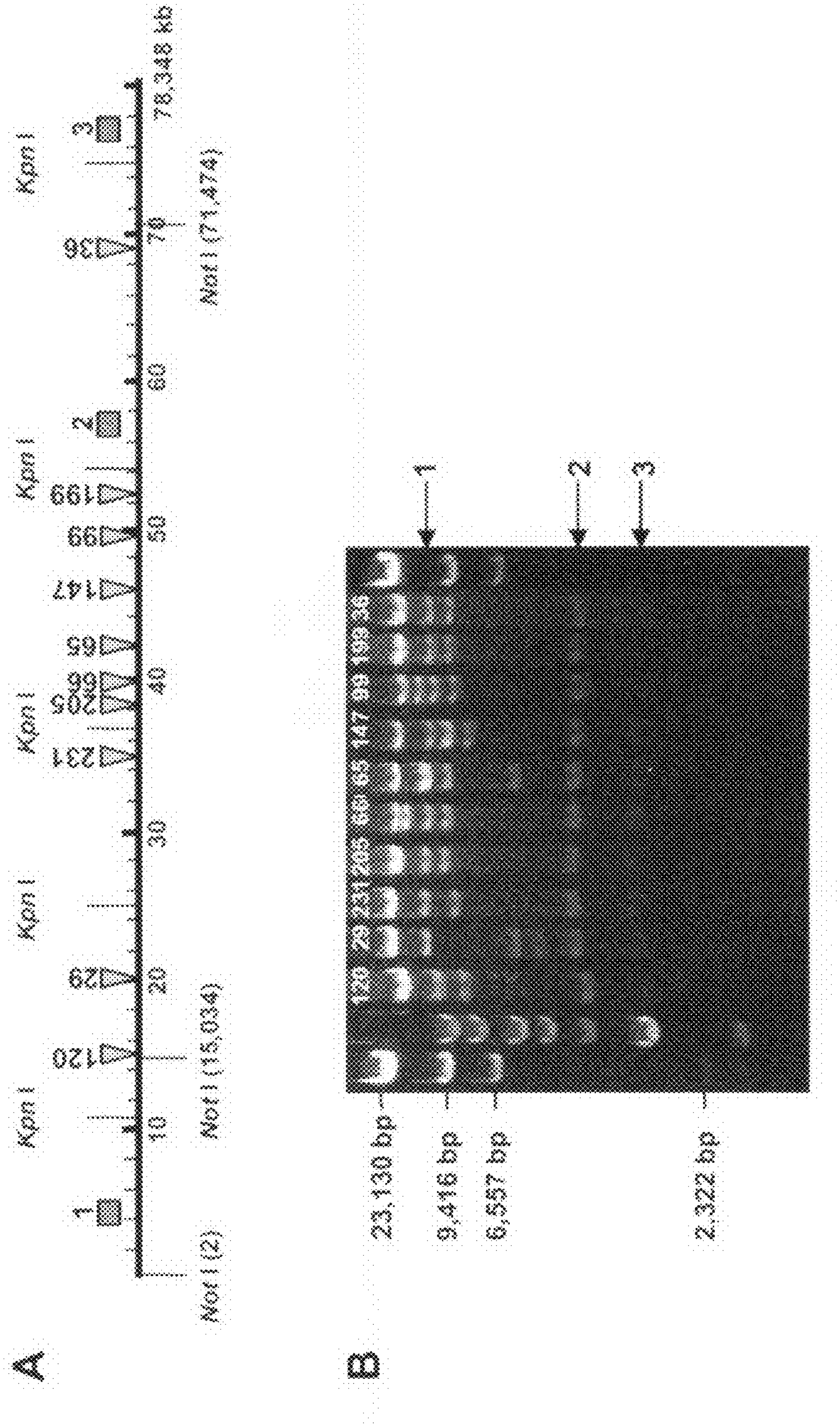

FIG. 23. Verification of the restriction maps of GS-43D16. A, KpnI and NotI map of the assembled GS_43D16 sequence. B, KpnI and NotI double digestion of selected GS_43D16 clones carrying the EZ::TN <NotI/KAN-3> transposon insertions. Eight fragments were expected from double digestion with both enzymes (2A). Only five fragments were observed, because some of the fragments showed to have similar mobilities in the gel. Some of these were resolved because of transposon insertions in them. We observed a close relationship between the restriction fragment sizes determined based gel electrophoresis and that based on sequence data and location of transposon insertions (Table 1). m1, λ/Hind III ladders, m2, 1 kb DNA ladder (New England Biolabs Inc., Beverly, Mass.). C, SalI-NotI map of the assembled GS_43D16 sequence. D, SalI and NotI digestion of GS_43D16. Eight fragments were expected from the double digestion of GS_43D16 (FIG. 2C). Six fragments were resolved from the digestion of the clone (43 in 2D). 7.9 kb and 7.11 kb fragments were not resolved (Fragment IV, twice the intensity of either Fragment III or Fragment V) and 0.6 kb SalI-NotI fragment is not included in 2D.

Figure 24:
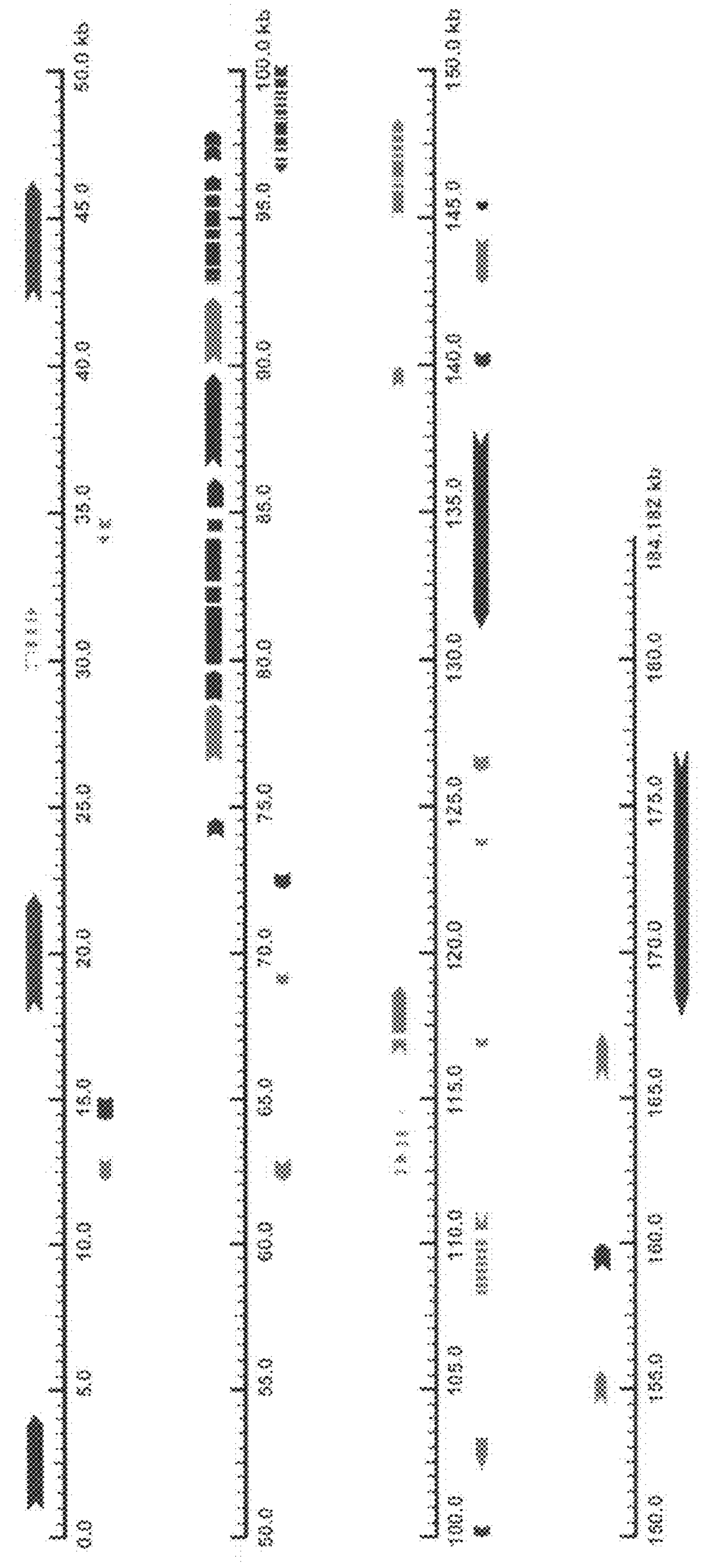

FIG. 24. Arrangements of predicted genes and retrotranspons in the Rps1-k region. The green colored boxes represent full-length genes; the red colored boxes represent partial genes; the blues colored boxes represent retroelements; white boxes represent introns in the predicted genes. Boxes above the ruler represent genes that have coding sequence on the forward strand, whereas the boxes under the ruler indicate the genes that are on the reverse strand. Detail annotation data are presented in Table 2.

Figure 25:
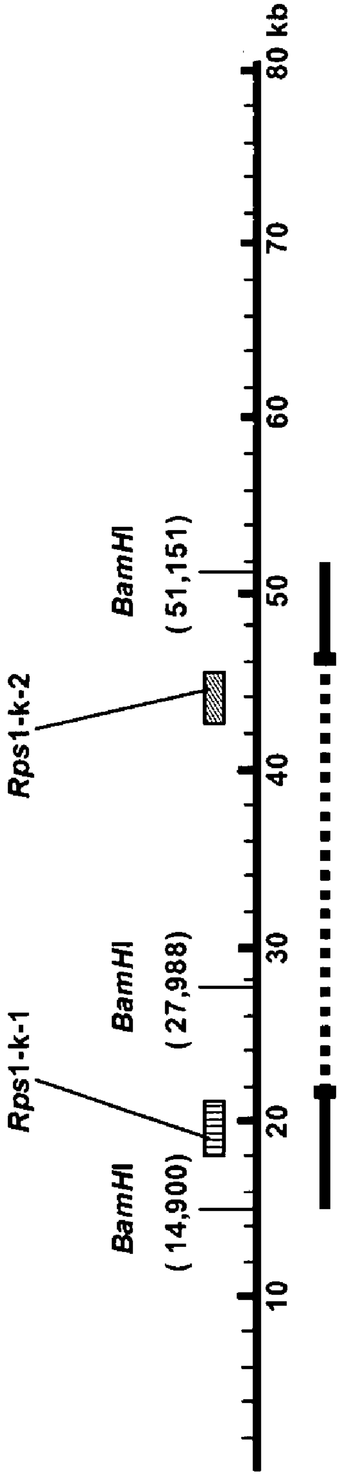

FIG. 25. The Rps1-k locus contains two CC-NB-LRR genes, Rps1-k-1 and Rps1-k-2. Locations of Rps1-k-1 and Rps1-k-2 on the GS_43D16 sequence are shown. Three BamHI sites involved in generation of the binary clone p43-10 carrying Rps1-k-3 (Gao et al. 2005) are shown on the map. Rps1-k-3 gene presumably originated from recombination in *E. coli*. Solid line shows the region in p43-10 and broken line indicates the region lost during the recombination process in *E. coli* and absent in p43-10. The two identical 174 bp sequences involved in the recombination process are shown by two black boxes flanking the broken line.

FIG. 26 A-AAA SEQ ID NO:246, Rps1-k contig sequence.

DEFINITIONS

Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges are inclusive of the numbers defining the range and include each integer within the defined range. Amino acids may be referred to herein by either their commonly known three letter symbols or by the one-letter symbols recommended by the IUPAC-IUB Biochemical nomenclature Commission. Nucleotides, likewise, may be referred to by their commonly accepted single-letter codes. Unless otherwise provided for, software, electrical, and electronics terms as used herein are as defined in The New IEEE Standard Dictionary of Electrical and Electronics Terms ($5^{th}$ edition, 1993). The terms defined below are more fully defined by reference to the specification as a whole.

As used herein the term, "Rps1-k like activity" shall mean that a molecule retains the biological activity of Rps1-k, more particularly that the molecule retains its ability to confer increased or improved resistance to a pathogen such as *Phytophthora* in a plant which expresses the protein as compared to a plant which does not express the protein.

By "amplified" is meant the construction of multiple copies of a nucleic acid sequence or multiple copies complementary to the nucleic acid sequence using at least one of the nucleic acid sequences as a template. Amplification systems include the polymerase chain reaction (PCR) system, ligase chain reaction (LCR) system, nucleic acid sequence based amplification (NASBA, Canteen, Mississauga, Ontario), Q-Beta Replicase systems, transcription-based amplification system (TAS), and strand displacement amplification (SDA). See, e.g., *Diagnostic Molecular Microbiology: Principles and Applications*, D. H. Persing et al., Ed., American Society for Microbiology, Washington, D.C. (1993). The product of amplification is termed an amplicon.

As used herein, "chromosomal region" includes reference to a length of a chromosome that may be measured by reference to the linear segment of DNA that it comprises. The chromosomal region can be defined by reference to two unique DNA sequences, i.e., markers.

The term "conservatively modified variants" applies to both amino acid and nucleic acid sequences. With respect to particular nucleic acid sequences, conservatively modified variants refers to those nucleic acids which encode identical or conservatively modified variants of the amino acid sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations" and represent one species of conservatively modified variation. Every nucleic acid sequence herein that encodes a polypeptide also, by reference to the genetic code, describes every possible silent variation of the nucleic acid. One of ordinary skill will recognize that each codon in a nucleic acid (except AUG, which is ordinarily the only codon for methionine; and UGG, which is ordinarily the only codon for tryptophan) can be modified to yield a functionally identical molecule. Accordingly, each silent variation of a nucleic acid which encodes a polypeptide of the present invention is implicit in each described polypeptide sequence and is within the scope of the present invention.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Thus, any number of amino acid residues selected from the group of integers consisting of from 1 to 15 can be so altered. Thus, for example, 1, 2, 3, 4, 5, 7, or 10 alterations can be made. Conservatively modified variants typically provide similar biological activity as the unmodified polypeptide sequence from which they are derived. For example, substrate specificity, enzyme activity, or ligand/receptor binding is generally at least 30%, 40%, 50%, 60%, 70%, 80%, or 90% of the native protein for its native substrate. Conservative substitution tables providing functionally similar amino acids are well known in the art.

The following six groups each contain amino acids that are conservative substitutions for one another:

1) Alanine (A), Serine (S), Threonine (T);

2) Aspartic acid (D), Glutamic acid (E);

3) Asparagine (N), Glutamine (Q);

4) Arginine (R), Lysine (K);

5) Isoleucine (I), Leucine (L), Methionine (M), Valine (V); and

6) Phenylalanine (F), Tyrosine (Y), Tryptophan (W).

See also, Creighton (1984) Proteins W.H. Freeman and Company.

By "encoding" or "encoded", with respect to a specified nucleic acid, is meant comprising the information for translation into the specified protein. A nucleic acid encoding a protein may comprise non-translated sequences (e.g., introns) within translated regions of the nucleic acid, or may lack such intervening non-translated sequences (e.g., as in cDNA). The information by which a protein is encoded is specified by the use of codons. Typically, the amino acid sequence is encoded by the nucleic acid using the "universal" genetic code. However, variants of the universal code, such as are present in some plant, animal, and fungal mitochondria, the bacterium *Mycoplasma capricolum*, or the ciliate Macronucleus, may be used when the nucleic acid is expressed therein.

When the nucleic acid is prepared or altered synthetically, advantage can be taken of known codon preferences of the intended host where the nucleic acid is to be expressed. For example, although nucleic acid sequences of the present invention may be expressed in both monocotyledonous and dicotyledonous plant species, sequences can be modified to account for the specific codon preferences and GC content preferences of monocotyledons or dicotyledons as these preferences have been shown to differ (Murray et al. *Nucl. Acids Res.* 17:477-498 (1989)). Thus, the maize preferred codon for a particular amino acid may be derived from known gene sequences from maize. Maize codon usage for 28 genes from maize plants are listed in Table 4 of Murray et al., supra.

As used herein "full-length sequence" in reference to a specified polynucleotide or its encoded protein means having the entire amino acid sequence of, a native (non-synthetic), endogenous, biologically active form of the specified protein. Methods to determine whether a sequence is full-length are well known in the art including such exemplary techniques as northern or western blots, primer extensions, S1 protection, and ribonuclease protection. See, e.g., *Plant Molecular Biology: A Laboratory Manual*, Clark, Ed., Springer-Verlag, Berlin (1997). Comparison to known full-length homologous (orthologous and/or paralogous) sequences can also be used to identify full-length sequences of the present invention. Additionally, consensus sequences typically present at the 5' and 3' untranslated regions of mRNA aid in the identification of a polynucleotide as full-length. For example, the consensus sequence ANNNNAUGG, where the underlined codon represents the N-terminal methionine, aids in determining whether the polynucleotide has a complete 5' end. Consensus sequences at the 3' end, such as polyadenylation sequences, aid in determining whether the polynucleotide has a complete 3' end.

As used herein, "heterologous" in reference to a nucleic acid is a nucleic acid that originates from a foreign species, or, if from the same species, is substantially modified from its native form in composition and/or genomic locus by deliberate human intervention. For example, a promoter operably linked to a heterologous structural gene is from a species different from that from which the structural gene was derived, or, if from the same species, one or both are substantially modified from their original form. A heterologous protein may originate from a foreign species or, if from the same species, is substantially modified from its original form by deliberate human intervention.

By "host cell" is meant a cell which contains a vector and supports the replication and/or expression of the vector. Host cells may be prokaryotic cells such as *E. coli*, or eukaryotic cells such as yeast, insect, amphibian, or mammalian cells. Preferably, host cells are monocotyledonous or dicotyledonous plant cells. A particularly preferred monocotyledonous host cell is a maize host cell.

The term "hybridization complex" includes reference to a duplex nucleic acid structure formed by two single-stranded nucleic acid sequences selectively hybridized with each other.

The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be incorporated into the genome of the cell (e.g., chromosome, plasmid, plastid or mitochondrial DNA), converted into an autonomous replicon, or transiently expressed (e.g., transfected mRNA).

The term "isolated" refers to material, such as a nucleic acid or a protein, which is: (1) substantially or essentially free from components that normally accompany or interact with it as found in its naturally occurring environment. The isolated material optionally comprises material not found with the material in its natural environment; or (2) if the material is in its natural environment, the material has been synthetically (non-naturally) altered by deliberate human intervention to a composition and/or placed at a location in the cell (e.g., genome or subcellular organelle) not native to a material found in that environment. The alteration to yield the synthetic material can be performed on the material within or removed from its natural state. For example, a naturally occurring nucleic acid becomes an isolated nucleic acid if it is altered, or if it is transcribed from DNA which has been altered, by means of human intervention performed within the cell from which it originates. See, e.g., Compounds and Methods for Site Directed Mutagenesis in Eukaryotic Cells, Kmiec, U.S. Pat. No. 5,565,350; In Vivo Homologous Sequence Targeting in Eukaryotic Cells; Zarling et al., PCT/US93/03868. Likewise, a naturally occurring nucleic acid (e.g., a promoter) becomes isolated if it is introduced by non-naturally occurring means to a locus of the genome not native to that nucleic acid. Nucleic acids which are "isolated" as defined herein, are also referred to as "heterologous" nucleic acids.

As used herein, "localized within the chromosomal region defined by and including" with respect to particular markers includes reference to a contiguous length of a chromosome delimited by and including the stated markers.

As used herein, "marker" includes reference to a locus on a chromosome that serves to identify a unique position on the chromosome. A "polymorphic marker" includes reference to a marker which appears in multiple forms (alleles) such that different forms of the marker, when they are present in a homologous pair, allow transmission of each of the chromosomes of that pair to be followed. A genotype may be defined by use of one or a plurality of markers.

As used herein, "nucleic acid" includes reference to a deoxyribonucleotide or ribonucleotide polymer in either single- or double-stranded form, and unless otherwise limited, encompasses known analogues having the essential nature of natural nucleotides in that they hybridize to single-stranded nucleic acids in a manner similar to naturally occurring nucleotides (e.g., peptide nucleic acids).

By "nucleic acid library" is meant a collection of isolated DNA or cDNA molecules which comprise and substantially represent the entire transcribed fraction of a genome of a specified organism. Construction of exemplary nucleic acid libraries, such as genomic and cDNA libraries, is taught in standard molecular biology references such as Berger and Kimmel, *Guide to Molecular Cloning Techniques, Methods in Enzymology*, Vol. 152, Academic Press, Inc., San Diego, Calif. (Berger); Sambrook et al., *Molecular Cloning—A Laboratory Manual*, $2^{nd}$ ed., Vol. 1-3 (1989); and Current Protocols in Molecular Biology, F. M. Ausubel et al., Eds., Current Protocols, a joint venture between Greene Publishing Associates, Inc. and John Wiley & Sons, Inc. (1994).

As used herein "operably linked" includes reference t a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame.

As used herein, the term "plant" can include reference to whole plants, plant parts or organs (e.g., leaves, stems, roots, etc.), plant cells, seeds and progeny of same. Plant cell, as used herein, further includes, without limitation, cells obtained from or found in: seeds, suspension cultures, embryos, meristematic regions, callus tissue, leaves, roots, shoots, gametophytes, sporophytes, pollen, and microspores. Plant cells can also be understood to include modified cells, such as protoplasts, obtained from the aforementioned tissues. The class of plants which can be used in the methods of the invention is generally as broad as the class of higher plants amenable to transformation techniques, including both monocotyledonous and dicotyledonous plants. Particularly preferred plants include maize, soybean, sunflower, sorghum, canola, wheat, alfalfa, cotton, rice, barley, and millet.

As used herein, "polynucleotide" includes reference to a deoxyribopolynucleotide, ribopolynucleotide, or analogs thereof that have the essential nature of a natural ribonucleotide in that they hybridize, under stringent hybridization conditions, to substantially the same nucleotide sequence as naturally occurring nucleotides and/or allow translation into the same amino acid(s) as the naturally occurring nucleotide(s). A polynucleotide can be full-length or a subsequence of a native or heterologous structural or regulatory gene. Unless otherwise indicated, the term includes reference to the specified sequence as well as the complementary sequence thereof. Thus, DNAs or RNAs with backbones modified for stability or for other reasons as "polynucleotides" as that term is intended herein. Moreover, DNAs or RNAs comprising unusual bases, such as inosine, or modified bases, such as tritylated bases, to name just two examples, are polynucleotides as the term is used herein. It will be appreciated that a great variety of modifications have been made to DNA and RNA that serve many useful purposes known to those of skill in the art. The term polynucleotide as it is employed herein embraces such chemically, enzymatically or metabolically modified forms of polynucleotides, as well as the chemical forms of DNA and RNA characteristic of viruses and cells, including among other things, simple and complex cells.

The terms "polypeptide", "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The essential nature of such analogues of naturally occurring amino acids is that, when incorporated into a protein, that protein is specifically reactive to antibodies elicited to the same protein but consisting entirely of naturally occurring amino acids. The terms "polypeptide", "peptide" and "protein" are also inclusive of modifications including, but not limited to, glycosylation, lipid attachment, sulfation, gamma-carboxylation of glutamic acid residues, hydroxylation and ADP-ribosylation. It will be appreciated, as is well known and as noted above, that polypeptides are not entirely linear. For instance, polypeptides may be branched as a result of ubiquitination, and they may be circular, with or without branching, generally as a result of posttranslation events, including natural processing event and events brought about by human manipulation which do not occur naturally. Circular, branched and branched circular polypeptides may be synthesized by non-translation natural process and by entirely synthetic methods, as well. Further, this invention contemplates the use of both the methionine-containing and the methionine-less amino terminal variants of the protein of the invention.

As used herein "promoter" includes reference to a region of DNA upstream from the start of transcription and involved in recognition and binding of RNA polymerase and other proteins to initiate transcription. A "plant promoter" is a promoter capable of initiating transcription in plant cells whether nor not its origin is a plant cell. Exemplary plant promoters include, but are not limited to, those that are obtained from plants, plant viruses, and bacteria which comprise genes expressed in plant cells such as *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissue are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions or the presence of light. Tissue specific, tissue preferred, cell type specific, and inducible promoters constitute the class of "non-constitutive" promoters. A "constitutive" promoter is a promoter which is active under most environmental conditions.

As used herein "recombinant" includes reference to a cell or vector, that has been modified by the introduction of a heterologous nucleic acid or that the cell is derived from a cell so modified. Thus, for example, recombinant cells express genes that are not found in identical form within the native (non-recombinant) form of the cell or express native genes that are otherwise abnormally expressed, under-expressed or not expressed at all as a result of deliberate human intervention. The term "recombinant" as used herein does not encompass the alteration of the cell or vector by naturally occurring events (e.g., spontaneous mutation, natural transformation/transduction/transposition) such as those occurring without deliberate human intervention.

As used herein, a "recombinant expression cassette" is a nucleic acid construct, generated recombinantly or synthetically, with a series of specified nucleic acid elements which permit transcription of a particular nucleic acid in a host cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid to be transcribed, and a promoter.

The term "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass non-natural analogs of natural amino acids that can function in a similar manner as naturally occurring amino acids.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, preferably 90% sequence identity, and most preferably 100% sequence identity (i.e., complementary) with each other.

The term "stringent conditions" or "stringent hybridization conditions" includes reference to conditions under which a probe will hybridize to its target sequence, to a detectably greater degree than to other sequences (e.g., at least 2-fold over background). Stringent conditions are sequence-dependent and be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaC1, 1% SDS (sodium dodecyl sulphate) at 37° C., and a wash in 1× to 2×SSC (20×SSC=3.0 M NaC1/0.3 M trisodium citrate) at 50 to 55° C. Exemplary moderate stringency conditions include hybridization in 40 to 45% formamide, 1 M NaC1, 1% SDS at 37° C., and a wash in 0.5× to 1×SSC at 55 to 50° C. Exemplary high stringency conditions include hybridization in 50% formamide, 1 M NaC1, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth and Wahl, *Anal. Biochem.,* 138:267-284 (1984): $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of the complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acids Probes*, Part I, Chapter 2, Ausubel, et al., Eds., Greene Publishing and Wiley-Interscience, New York (1995). In general a high stringency wash is 2×15 min in 0.5×SSC containing 0.1% SDS at 65° C.

As used herein, "transgenic plant" includes reference to a plant which comprises within its genome a heterologous polynucleotide. Generally, the heterologous polynucleotide is stably integrated within the genome such that the polynucleotide is passed on to successive generations. The heterologous polynucleotide may be integrated into the genome alone or as part of a recombinant expression cassette. "Transgenic" is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

As used herein, "vector" includes reference to a nucleic acid used in transfection of a host cell and into which can be inserted a polynucleotide. Vectors are often replicons. Expression vectors permit transcription of a nucleic acid inserted therein.

The following terms are used to describe the sequence relationships between two or more nucleic acids or polynucleotides: (a) "reference sequence", (b) "comparison window", (c) "sequence identity", (d) "percentage of sequence identity", and (e) "substantial identity".

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

(b) As used herein, "comparison window" includes reference to a contiguous and specified segment of a polynucleotide sequence, wherein the polynucleotide sequence may be compared to a reference sequence and wherein the portion of the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence, a gap penalty is typically introduced and is subtracted from the number of matches.

Methods of alignment of sequences for comparison are well-known in the art. Optimal alignment of sequences for comparison may be conducted by the local homology algorithm of Smith and Waterman, *Adv. Appl. Math.* 2:482 (1981); by the homology alignment algorithm of Needleman and Wunsch, *J. Mol. Biol.* 48:443 (1970); by the search for similarity method of Pearson and Lipman, *Proc. Natl. Acad. Sci.* 85:2444 (1988); by computerized implementations of these algorithms, including, but not limited to: CLUSTAL in the PC/Gene program by Intelligenetics, Mountain View, Calif.; GAP, BESTFIT, BLAST, FASTA, and TFASTA in the Wisconsin Genetics Software Package, Genetics Computer Group (GCG), 575 Science Dr., Madison, Wis., USA; the CLUSTAL program is well described by Higgins and Sharp, *Gene* 73:237-244 (1988); Higgins and Sharp, CABIOS 5:151-153 (1989); Corpet, et al., *Nucleic Acids Research* 16:10881-90 (1988); Huang, et al., *Computer Applications in the Biosciences* 8:155-65 (1992), and Pearson, et al., *Methods in Molecular Biology* 24:307-331 (1994). The BLAST family of programs which can be used for database similarity searches includes: BLASTN for nucleotide query sequences against nucleotide database sequences; BLASTX for nucleotide query sequences against protein database sequences; BLASTP for protein query sequences against protein database sequences; TBLASTN for protein query sequences against nucleotide database sequences; and TBLASTX for nucleotide query sequences against nucleotide database sequences. See, *Current Protocols in Molecular Biology*, Chapter 19, Ausubel, et al., Eds., Greene Publishing and Wiley-Interscience, New York (1995).

Unless otherwise stated, sequence identity/similarity values provided herein refer to the value obtained using the BLAST 2.0 suite of programs using default parameters. Altschul et al., Nucleic Acids Res. 25:3389-3402 (1997). Software for performing BLAST analyses is publicly available, e.g., through the National Center for Biotechnology-Information (www.hcbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) *Proc. Natl. Acad. Sci. USA* 89:10915).

In addition to calculating percent sequence identity, the BLAST algorithm also performs a statistical analysis of the similarity between two sequences (see, e.g., Karlin & Altschul, *Proc. Natl. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance.

BLAST searches assume that proteins can be modeled as random sequences. However, many real proteins comprise regions of nonrandom sequences which may be homopolymeric tracts, short-period repeats, or regions enriched in one or more amino acids. Such low-complexity regions may be aligned between unrelated proteins even though other regions of the protein are entirely dissimilar. A number of low-complexity filter programs can be employed to reduce such low-complexity alignments. For example, the SEG (Wooten and Federhen, *Comput. Chem.,* 17:149-163 (1993)) and XNU (Claverie and States, *Comput. Chem.,* 17:191-201 (1993)) low-complexity filters can be employed alone or in combination.

(c) As used herein, "sequence identity" or "identity" in the context of two nucleic acid or polypeptide sequences includes reference to the residues in the two sequences which are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are said to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, *Computer Applic. Biol. Sci.,* 4:11-17 (1988) e.g., as implemented in the program PC/GENE (Intelligenetics, Mountain View, Calif., USA).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

(e) The term "substantial identity" of polynucleotide sequences means that a polynucleotide comprises a sequence that has at least 70% sequence identity, preferably at least 80%, more preferably at least 90% and most preferably at least 95%, compared to a reference sequence using one of the alignment programs described using standard parameters. One of skill will recognize that these values can be appropriately adjusted to determine corresponding identity of proteins encoded by two nucleotide sequences by taking into account codon degeneracy, amino acid similarity, reading frame positioning and the like. Substantial identity of amino acid sequences for these purposes normally means sequence identity of at least 60%, ore preferably at least 70%, 80%, 90%, and most preferably at least 95%.

Another indication that nucleotide sequences are substantially identical is if two molecules hybridize to each other under stringent conditions. However, nucleic acids which do not hybridize to each other under stringent conditions are still substantially identical if the polypeptides which they encode are substantially identical. This may occur, e.g., when a copy of a nucleic acid is created using the maximum codon degeneracy permitted by the genetic code. One indication that two nucleic acid sequences are substantially identical is that the polypeptide which the first nucleic acid encodes is immunologically cross reactive with the polypeptide encoded by the second nucleic acid.

(e) The terms "substantial Identity" in the context of a peptide indicates that a peptide comprises a sequence with at least 70% sequence identity to a reference sequence, preferably 80%, ore preferably 85%, most preferably at least 90% or 95% sequence identity to the reference sequence over a specified comparison window. Optionally, optimal alignment is conducted using the homology alignment algorithm of Needleman and Wunsch, *J. Mol. Biol.* 48:443 (1970). an indication that two peptide sequences are substantially identical is that one peptide is immunologically reactive with antibodies raised against the second peptide. Thus, a peptide is substantially identical to a second peptide, for example, where the two peptides differ only by a conservative substitution. Peptides which are "substantially similar" share sequences as noted above except that residue positions which are not identical may differ by conservative amino acid changes.

The present invention provides, inter alia, compositions and methods for promoting pathogen resistance in plants, more particularly for improving *Phytophthora* resistance of susceptible plants. The compositions of the invention relate to the Rps1-k family of nucleic acid molecules comprising sequences which are known to confer *Phytophthora* resistance in soybeans. These compositions can be transferred into plants to confer or improve *Phytophthora* resistance, modified to engineer gene sequences for broad based non specific resistance in plants, or to isolate and identify other members of the Rps1 family. By "confer or improve *Phytophthora* or other such pathogen resistance" is intended that the proteins or sequences, either alone or in combination with other proteins or sequences, enhance resistance of a plant to *Phytophthora* and *Phytophthora*-caused damage or to other pathogens which cause a similar plant reaction. In this manner, resistance to these fungal pathogens and other pathogens such as *Pseudomonas syringae* pv. *glycinea* (Psg), soybean cyst nematode (SCN), or soybean mosaic virus (SMV) can be enhanced or improved in the transformed plant or its progeny when at least one of the sequences of the invention is provided.

The compositions include nucleic acid molecules comprising sequences of plant genes and the polypeptides encoded thereby. Particularly, the nucleotide and amino acid sequence for the two classes of the Rps1-k family have been isolated. As discussed in more detail below, the sequences of the invention are presumably involved in many basic biochemical pathways that regulate plant pathogen resistance. Thus, methods are provided for the expression of these sequences in a host plant to modulate plant defense responses. Some of the methods involve stably transforming a plant with a nucleotide sequence of the invention operably linked with a promoter capable of driving expression of a gene in a plant cell.

Promoter and other regulatory elements which are natively associated with these genes can be easily isolated using the sequences and methods described herein with no more than routine experimentation. These sequences can also be used to identify promoter, enhancer or other signaling sequences in the regulatory regions of pathogen resistance genes. Such regulatory elements or promoters would provide for temporal and spatial expression of operably linked sequences with pathogen infection in a plant. Nucleotide sequences operably linked to such promoter sequences are transformed into a plant cell. Exposure of the transformed plant to a stimulus such as pathogen infection could induce transcriptional activation of the nucleotide sequences operably linked to these promoter regulatory sequences.

Transformed plants can be obtained having altered or enhanced responses to fungal pathogen attack; hence, the methods and compositions may find uses in altering the response of plants to similar stresses as well. Thus, the sequences of the invention find use in engineering broad-spectrum disease and pest resistance in a variety of plants. A polypeptide is said to have Rps1-k-like activity when it has one or more of the properties of the native protein. It is within the skill in the art to assay protein activities obtained from various sources to determine whether the properties of the proteins are the same. In so doing, one of skill in the art may employ any of a wide array of known assays including, for example, biochemical and/or pathological assays. For example, one of skill in the art could readily produce a plant transformed with a Rps1-k polypeptide variant and assay a property of native Rps1-k protein in that plant material to determine whether a particular Rps1-k property was retained by the variant.

The compositions and methods of the invention are presumably involved in biochemical pathways and as such may also find use in the activation or modulation of expression of other genes, including those involved in other aspects of pathogen response.

Although there is much conservation among these genes, proteins encoded by members of this gene family may contain different elements or motifs or sequence patterns that modulate or affect the activity, subcellular localization, and/or target of the protein in which they are found. For example, one form of Rps1-k was found active only in the roots of soybean plants (Bhattacharyya, unpublished). Such elements, motifs, or sequence patterns may be useful in engineering novel enzymes for modulating gene expression in particular tissues. By "modulating" or "modulation" is intended that the level of expression of a gene may be increased or decreased relative to genes driven by other promoters or relative to the normal or uninduced level of the gene in question.

The present invention provides for isolated nucleic acid molecules comprising nucleotide sequences encoding the amino acid sequence shown in the Figures attached (see examples 2 and 4) and their conservatively modified variants. Further provided are polypeptides having an amino acid sequence encoded by a nucleic acid molecule described herein, for example those polypeptides comprising the sequences set forth in the figures herein, and fragments and variants thereof.

The present invention also provides 6 similar structural domains which were identified to be present in each of the members of the Rps1-kRps1-k family and that have previously been known to be associated with pathogen resistance. Thus the invention comprises proteins which conserved these elements of genes encoding the same which may be optimized for pathogen resistance. According to the invention domain A was found to have a myristylation site, domain B a coiled coil motif, domain C is the putative NBS domain, consisting or a P loop, kinase-2 and kinase-3a motifs. In this region all 11 Pan-defined motifs for CC-NBS-LRR R proteins were observed. Between domain C and E is a short region designated as domain D. Domain E comprises 26 imperfect LRRs. At the beginning of domain E there is a leucine-zipper-like motif. Thus the invention comprises an Rps1-k protein having one or more of the conserved structural domains described herein and which retains Rps1-k-like activity.

The invention encompasses isolated or substantially purified nucleic acid or protein compositions. An "isolated" or "purified" nucleic acid molecule or protein, or biologically active portion thereof, is substantially free of other cellular material, or culture medium when produced by recombinant techniques, or substantially free of chemical precursors or other chemicals when chemically synthesized. In some embodiments, an "isolated" nucleic acid is free of sequences (such as other protein-encoding sequences) that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, 0.4 kb, 0.3 kb, 0.2 kb, or 0.1 kb, or 50, 40, 30, 20, or 10 nucleotides that naturally flank the nucleic acid molecule in genomic DNA of the cell from which the nucleic acid is derived. A protein that is substantially free of cellular material includes preparations of protein having less than about 30%, 20%, 10%, 5%, (by dry weight) of contaminating protein. When the protein of the invention or biologically active portion thereof is recombinantly produced, culture medium may represent less than about 30%, 20%, 10%, or 5% (by dry weight) of chemical precursors or non-protein-of-interest chemicals.

Fragments and variants of the disclosed nucleotide sequences are encompassed by the present invention. Fragments and variants of proteins encoded by the disclosed nucleotide sequences are also encompassed by the present invention. By "fragment" is intended a portion of the nucleotide sequence or a portion of the amino acid sequence and hence protein encoded thereby. Fragments of a nucleotide sequence may encode protein fragments that retain the biological activity of the native protein and hence affect development, developmental pathways, stress responses, and/or disease resistance by retaining Rps1-k-like activity. Alternatively, fragments of a nucleotide sequence that are useful as hybridization probes generally do not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins of the invention.

A fragment of a Rps1-k nucleotide sequence that encodes a biologically active portion of a RPS1k protein of the invention will encode at least 12, 25, 30, 50, 75, etc. contiguous amino acids, or up to the total number of amino acids present in a full-length Rps1-k protein of the invention.

Fragments of an Rps1-k nucleotide sequence that are useful as hybridization probes or PCR primers generally may or may not encode a biologically active portion of a protein. Thus, a fragment of an Rps1-k nucleotide sequence may encode a biologically active portion of an Rps1-k protein, or it may be used as a hybridization probe or PCR primer using methods disclosed below. A biologically active portion of an Rps1-k protein can be prepared by isolating a portion of the Rps1-k nucleotide sequences of the invention, expressing the encoded portion of the Rps1-k protein (e.g., by recombinant expression in vitro), and assessing the activity of the encoded portion of the Rps1-k protein. Nucleic acid molecules that are fragments of an Rps1-k nucleotide sequence comprise at least 16, 20, 25, 30, 40, 50, 60, 70, 80, 90, 100, 125, 150, 175, 200, etc. nucleotides, or up to the number of nucleotides present in a full-length Rps1-k nucleotide sequences disclosed herein.

The proteins of the invention may be altered in various ways including amino acid substitutions, deletions, truncations, and insertions. Methods for such manipulations are generally known in the art. For example, amino acid sequence variants of the Rps1-k proteins can be prepared by mutations in the DNA. Methods for mutagenesis and nucleotide sequence alterations are well known in the art. See, for example, Kunkel (1985) *Proc. Nad. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be made.

It is recognized that having identified the nucleotide sequences disclosed herein, it is within the state of the art to isolate and identify regulatory elements in the 5' untranslated region upstream from regions defined herein. Thus for example, the promoter regions of the gene sequences disclosed herein may further comprise upstream regulatory elements that confer tissue-preferred expression of heterologous nucleotide sequences operably linked to the disclosed promoter sequence. See particularly, Australian Patent No. AU-A-77751/94 and U.S. Pat. Nos. 5,466,785 and 5,635,618. It is also recognized by those of skill in the art that regulatory elements may be found in transcribed regions of a gene, for example in the region between transcription start and translation start as well as 3' to the end of translation; such elements may be found in the sequences set forth herein.

The nucleotide sequences of the invention can be used to isolate corresponding sequences from other organisms, particularly other plants, more particularly other crop plants. In this manner, methods such as PCR, hybridization, and the like can be used to identify such sequences based on their sequence homology to the sequences set forth herein. Sequences isolated based on their sequence identity to the nucleotide sequences set forth herein or to fragments thereof are encompassed by the present invention. Such sequences include sequences that are orthologs of the disclosed sequences. By "orthologs" is intended genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species. Thus, isolated sequences that have Rps1-k-like activity or and which hybridize under stringent conditions to the Rps1-k sequences disclosed herein, or to fragments thereof, are encompassed by the present invention.

In a PCR approach, oligonucleotide primers can be designed for use in PCR reactions to amplify corresponding DNA sequences from cDNA or genomic DNA extracted from any plant of interest. Methods for designing PCR primers and PCR cloning are generally known in the art and are disclosed in Sambrook et al. (1989) *Molecular Cloning: A Laboratory Manual* (2d ed., Cold Spring Harbor Laboratory Press Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

In hybridization techniques, all or part of a known nucleotide sequence is used as a probe that selectively hybridizes to other corresponding nucleotide sequences present it a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}P$, or any other detectable marker. Thus, for example, probes for hybridization can be made by labeling synthetic oligonucleotides based on the disease-resistant sequences of the invention. Methods for preparation of probes for hybridization and for construction of cDNA and genomic libraries are generally known in the art and are disclosed in Sambrook et al. (1989) *Molecular Cloning: A Laboratory Manual* (2d ed., Cold Spring Harbor Laboratory Press, Plainview, N.Y.).

For example, an entire sequence disclosed herein, or one or more portions thereof, may be used as a probe capable of specifically hybridizing to corresponding nematode-response sequences, including promoters and messenger RNAs. To achieve specific hybridization under a variety of conditions, such probes include sequences that are unique among nematode-response sequences and may be at least about 10 or 15 or 17 nucleotides in length or at least about 20 or 22 or 25 nucleotides in length. Such probes may be used to amplify corresponding sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook et al. (1989) *Molecular Cloning: A Laboratory Manual* (2d ed., Cold Spring Harbor Laboratory Press, Plainview, N.Y.).

Assays that measure antipathogenic activity induced by the signal pathway from the sequences herein are commonly known in the art, as are methods to quantitate disease resistance in plants following pathogen infection. See, for example, U.S. Pat. No. 5,614,395, herein incorporated by reference. These assays may be used to measure the activity of the polypeptides of the invention. Such techniques include, measuring over time, the average lesion diameter, the pathogen biomass, and the overall percentage of decayed plant tissues. For example, a plant either expressing an antipathogenic polypeptide or having an antipathogenic composition applied to its surface shows a decrease in tissue necrosis (i.e., lesion diameter) or a decrease in plant death following pathogen challenge when compared to a control plant that was not exposed to the antipathogenic composition. Alternatively, antipathogenic activity can be measured by a decrease in pathogen biomass. For example, a plant expressing an antipathogenic polypeptide or exposed to an antipathogenic composition is challenged with a pathogen of interest. Over time, tissue samples from the pathogen-inoculated tissues are obtained and RNA is extracted. The percent of a specific pathogen RNA transcript relative to the level of a plant specific transcript allows the level of pathogen biomass to be determined. See, for example, Thomma et al. (1998) *Plant Biology* 95:15107-15111, herein incorporated by reference.

Furthermore, in vitro antipathogenic assays include, for example, the addition of varying concentrations of the antipathogenic composition to paper disks and placing the disks on agar containing a suspension of the pathogen of interest. Following incubation, clear inhibition zones develop around the discs that contain an effective concentration of the antipathogenic polypeptide (Liu et al. (1994) *Plant Biology* 91:1888-1892, herein incorporated by reference). Additionally, microspectrophotometrical analysis can be used to measure the in vitro antipathogenic properties of a composition (Hu et al. (1997) *Plant Mol. Biol.* 34:949-959 and Cammue et al. (1992) *J. Biol. Chem.* 267: 2228-2233, both of which are herein incorporated by reference).

Pathogens of the invention include, but are not limited to, fungal and viral pathogens for primarily soybeans which include: *Phytophthora megasperma* fsp. *glycinea, Macrophomina phaseolina, Rhizoctonia solani, Sclerotinia sclerotiorum, Fusarium oxysporum, Diaporthe phaseolorum* var. *sojae* (*Phomopsis sojae*), *Diaporthe phaseolorum* var. *caulivora, Sclerotium rolfsii, Cercospora kikuchii, Cercospora sojina, Peronospora manshurica, Colletotrichum dematium* (*Colletotichum truncatum*), *Corynespora cassfcola, Septoria glycines, Phyllosticta sojicola, Alternaria alternata, Pseudomonas syringae* p.v. *glycinea, Xanthomonas campestris* p.v. *phaseoli, Microsphaera diffusa, Fusarium semitectum, Phialophora gregata*, Soybean mosaic virus, *Glomerella glycines*, Tobacco Ring spot virus, Tobacco Streak virus, *Phakopsora pachyrhizi, Pythium aphanidennatum, Pythium ultimum, Pythium debaryanum*, Tomato spotted wilt virus, *Heterodera glycines, Fusarium solani*

It is understood in the art that plant DNA viruses and fungal pathogens remodel the control of the host replication and gene expression machinery to accomplish their own replication and effective infection. The plant response to stress, such as stress caused by *Phytophthora* attack, is known to involve many basic biochemical pathways and cellular functions. Hence, the sequences of the invention may find use in altering the defense mechanisms of a host plant to provide broad-based resistance to disease or insect pests. Additionally, the present invention may be useful in preventing corruption of the cell machinery by viruses and other plant pathogens.

The compositions and methods of the invention function to inhibit or prevent plant diseases. The gene products may accomplish their anti-pathogenic effects by suppressing, controlling, and/or killing the invading pathogenic organism through activation of a signal pathway leading to accumulation of defense compounds.

The cells that have been transformed may be grown into plants in accordance with conventional ways. See, for example, McCormick et al. (1986) *Plant Cell Reports* 5:8184. These plants may then be grown, and either pollinated with the same transformed strain or different strains, and the resulting hybrid having constitutive expression of the desired phenotypic characteristic identified. Two or more generations may be grown to ensure that constitutive expression of the desired phenotypic characteristic is stably maintained and inherited and then seeds harvested to ensure constitutive expression of the desired phenotypic characteristic has been achieved.

The invention in one aspect comprises expression constructs comprising a DNA sequence which encodes upon expression an Rps1-k gene product operably linked to a promoter to direct expression of the protein. These constructs are then introduced into plant cells using standard molecular biology techniques. The invention can be also be used for hybrid plant or seed production, once transgenic inbred parental lines have been established.

In another aspect the invention involves the inhibition of the regulatory gene product in plants through introduction of a construct designed to inhibit the same gene product. The design and introduction of such constructs based upon known DNA sequences is known in the art and includes such technologies as antisense RNA or DNA, co-suppression or any other such mechanism. Several of these mechanisms are described and disclosed in U.S. Pat. No. 5,686,649 to Chua et. al, which is hereby expressly incorporated herein by reference.

The methods of the invention described herein may be applicable to any species of plant.

Production of a genetically modified plant tissue either expressing or inhibiting expression of a structural gene combines the teachings of the present disclosure with a variety of techniques and expedients known in the art. In most instances, alternate expedients exist for each stage of the overall process. The choice of expedients depends on the variables such as the plasmid vector system chosen for the cloning and introduction of the recombinant DNA molecule, the plant species to be modified, the particular structural gene, promoter elements and upstream elements used. Persons skilled in the art are able to select and use appropriate alternatives to achieve functionality. Culture conditions for expressing desired structural genes and cultured cells are known in the art. Also as known in the art, a number of both monocotyledonous and dicotyledonous plant species are transformable and regenerable such that whole plants containing and expressing desired genes under regulatory control of the promoter molecules according to the invention may be obtained. As is known to those of skill in the art, expression in transformed plants may be tissue specific and/or specific to certain developmental stages. Truncated promoter selection and structural gene selection are other parameters which may be optimized to achieve desired plant expression or inhibition as is known to those of skill in the art and taught herein.

The following is a non-limiting general overview of Molecular biology techniques which may be used in performing the methods of the invention.

Promoters

The constructs, promoters or control systems used in the methods of the invention may include a tissue specific promoter, an inducible promoter or a constitutive promoter.

A large number of suitable promoter systems are available. For example one constitutive promoter useful for the invention is the cauliflower mosaic virus (CaMV) 35S. It has been shown to be highly active in many plant organs and during many stages of development when integrated into the genome of transgenic plants and has been shown to confer expression in protoplasts of both dicots and monocots.

Organ-specific promoters are also well known. For example, the E8 promoter is only transcriptionally activated during tomato fruit ripening, and can be used to target gene expression in ripening tomato fruit (Deikman and Fischer, *EMBO J.* (1988) 7:3315; Giovannoni et al., *The Plant Cell* (1989) 1:53). The activity of the E8 promoter is not limited to tomato fruit, but is thought to be compatible with any system wherein ethylene activates biological processes. Similarly the Lipoxegenase ("the LOX gene") is a fruit specific promoter.

Other fruit specific promoters are the 1.45 promoter fragment disclosed in Bird, et al., *Plant Mol. Bio.*, pp 651-663 (1988) and the polygalacturonase promoter from tomato disclosed in U.S. Pat. No. 5,413,937 to Bridges et al. Leaf specific promoters include as the AS-1 promoter disclosed in U.S. Pat. No. 5,256,558 to Coruzzi and the RBCS-3A promoter isolated from pea the RBCS-3A gene disclosed in U.S. Pat. No. 5,023,179 to Lam et al.

And finally root specific promoters include the CamV 35S promoter disclosed in U.S. Pat. No. 391,725 to Coruzzi et al; the RB7 promoter disclosed in U.S. Pat. No. 5,459,252 to Conking et al and the promoter isolated from *Brassica napus* disclosed in U.S. Pat. No. 5,401,836 to Bazczynski et al. which give root specific expression.

Other examples of promoters include maternal tissue promoters such as seed coat, pericarp and ovule. Promoters highly expressed early in endosperm development are most effective in this application. Of particular interest is the promoter from the a' subunit of the soybean β-conglycinin gene [Walling et al., *Proc. Natl. Acad. Sci. USA* 83:2123-2127 (1986)] which is expressed early in seed development in the endosperm and the embryo.

Further seed specific promoters include the Napin promoter described in U.S. Pat. No. 5,110,728 to Calgene, which describes and discloses the use of the napin promoter in directing the expression to seed tissue of an acyl carrier protein to enhance seed oil production; the DC3 promoter from carrots which is early to mid embryo specific and is disclosed at *Plant Physiology*, October 1992 100(2) p. 576-581, "Hormonal and Environmental Regulation of the Carrot Lea-class Gene Dc 3, and *Plant Mol. Biol*., April 1992, 18(6) p. 1049-1063, "Transcriptional Regulation of a Seed Specific Carrot Gene, DC 8": the phaseolin promoter described in U.S. Pat. No. 5,504,200 to Mycogen which discloses the gene sequence and regulatory regions for phaseolin, a protein isolated from *P. vulgaris* which is expressed only while the seed is developing within the pod, and only in tissues involved in seed generation.

Other organ-specific promoters appropriate for a desired target organ can be isolated using known procedures. These control sequences are generally associated with genes uniquely expressed in the desired organ. In a typical higher plant, each organ has thousands of mRNAs that are absent from other organ systems (reviewed in Goldberg, Phil, *Trans. R. Soc. London* (1986) B314-343. mRNAs are first isolated to obtain suitable probes for retrieval of the appropriate genomic sequence which retains the presence of the natively associated control sequences. An example of the use of techniques to obtain the cDNA associated with mRNA specific to avocado fruit is found in Christoffersen et al., *Plant Molecular Biology* (1984) 3:385. Briefly, mRNA was isolated from ripening avocado fruit and used to make a cDNA library. Clones in the library were identified that hybridized with labeled RNA isolated from ripening avocado fruit, but that did not hybridize with labeled RNAs isolated from unripe avocado fruit. Many of these clones represent mRNAs encoded by genes that are transcriptionally activated at the onset of avocado fruit ripening.

Another very important method that can be used to identify cell type specific promoters that allow even to identification of genes expressed in a single cell is enhancer detection (O'Kane, C., and Gehring, W. J. (1987), "Detection in situ of genomic regulatory elements in *Drosophila", Proc. Natl. Acad. Sci. USA,* 84, 9123-9127). This method was first developed in *Drosophila* and rapidly adapted to mice and plants (Wilson, C., Pearson, R. K., Bellen, H.J., O'Kane, C. J., Grossniklaus, U., and Gehring, W. J. (1989), "P-element-mediated enhancer detection: an efficient method for isolating and characterizing developmentally regulated genes in *Drosophila", Genes & Dev.,* 3, 1301-1313; Skarnes, W. C. (1990), "Entrapment vectors: a new tool for mammalian genetics", *Biotechnology,* 8, 827-831; Topping, J. F., Wei, W., and Lindsey, K. (1991), "Functional tagging of regulatory elements in the plant genome", *Development,* 112, 1009-1019; Sundaresan, V., Springer, P. S., Volpe, T., Haward, S., Jones, J. D. G., Dean, C., Ma, H., and Martienssen, R. A., (1995), "Patterns of gene action in plant development revealed by enhancer trap and gene trap transposable elements", *Genes & Dev.,* 9, 1797-1810).

The promoter used in the method of the invention may be an inducible promoter. An inducible promoter is a promoter that is capable of directly or indirectly activating transcription of a DNA sequence in response to an inducer. In the absence of an inducer, the DNA sequence will not be transcribed. Typically, the protein factor that binds specifically to an inducible promoter to activate transcription is present in an inactive form which is then directly or indirectly converted to the active form by the inducer. The inducer may be a chemical agent such as a protein, metabolite (sugar, alcohol etc.), a growth regulator, herbicide, or a phenolic compound or a physiological stress imposed directly by heat, salt, toxic elements etc. or indirectly through the action of a pathogen or disease agent such as a virus. A plant cell containing an inducible promoter may be exposed to an inducer by externally applying the inducer to the cell such as by spraying, watering, heating, or similar methods. Examples of inducible promoters include the inducible 70 kd heat shock promoter of *D. melanogaster* (Freeling, M., Bennet, D.C., Maize ADN 1, *Ann. Rev. of Genetics,* 19:297-323) and the alcohol dehydrogenase promoter which is induced by ethanol (Nagao, R. T., et al., Miflin, B. J., Ed. Oxford Surveys of Plant Molecular and Cell Biology, Vol. 3, p. 384-438, Oxford University Press, Oxford 1986) or the Lex A promoter which is triggered with chemical treatment and is available through Ligand pharmaceuticals. The inducible promoter may be in an induced state throughout seed formation or at least for a period which corresponds to the transcription of the DNA sequence of the recombinant DNA molecule(s).

Another example of an inducible promoter is the chemically inducible gene promoter sequence isolated from a 27 kd subunit of the maize glutathione-S-transferase (GST II) gene. Two of the inducers for this promoter are N,N-diallyl-2,2-dichloroacetamide (common name: dichloramid) or benzyl-=2-chloro-4-(trifluoromethyl)-5-thiazolecarboxylate (common name: flurazole). In addition, a number of other potential inducers may be used with this promoter as described in published PCT Application No. PCT/GB90/00110 by ICI.

Another example of an inducible promoter is the light inducible chlorophyll a/b binding protein (CAB) promoter, also described in published PCT Application No. PCT/GB90/00110 by ICI.

Inducible promoters have also been described in published Application No. EP89/103888.7 by Ciba-Geigy. In this application, a number of inducible promoters are identified, including the PR protein genes, especially the tobacco PR protein genes, such as PR-1a, PR-1b, PR-Ic, PR-1, PR-A, PR-S, the cucumber chitinase gene, and the acidic and basic tobacco beta-1,3-glucanase genes. There are numerous potential inducers for these promoters, as described in Application No. EP89/103888.7.

The preferred promoters may be used in conjunction with naturally occurring flanking coding or transcribed sequences of the feronia regulatory genes or with any other coding or transcribed sequence that is critical to pollin tube formation and/or fertilization.

It may also be desirable to include some intron sequences in the promoter constructs since the inclusion of intron sequences in the coding region may result in enhanced expression and specificity. Thus, it may be advantageous to join the DNA sequences to be expressed to a promoter sequence that contains the first intron and exon sequences of a polypeptide which is unique to cells/tissues of a plant critical to female gametophyte development and/or function.

Additionally, regions of one promoter may be joined to regions from a different promoter in order to obtain the desired promoter activity resulting in a chimeric promoter. Synthetic promoters which regulate gene expression may also be used.

The expression system may be further optimized by employing supplemental elements such as transcription terminators and/or enhancer elements.

Other Regulatory Elements

In addition to a promoter sequence, an expression cassette or construct should also contain a transcription termination region downstream of the structural gene to provide for efficient termination. The termination region or polyadenylation signal may be obtained from the same gene as the promoter sequence or may be obtained from different genes. Polyadenylation sequences include, but are not limited to the *Agrobacterium* octopine synthase signal (Gielen et al., *EMBO J.* (1984) 3:835-846) or the nopaline synthase signal (Depicker et al., *Mol. and Appl. Genet.* (1982) 1:561-573).

Marker Genes

Recombinant DNA molecules containing any of the DNA sequences and promoters described herein may additionally contain selection marker genes which encode a selection gene product which confer on a plant cell resistance to a chemical agent or physiological stress, or confers a distinguishable phenotypic characteristic to the cells such that plant cells transformed with the recombinant DNA molecule may be easily selected using a selective agent. One such selection marker gene is neomycin phosphotransferase (NPT II) which confers resistance to kanamycin and the antibiotic G-418. Cells transformed with this selection marker gene may be selected for by assaying for the presence in vitro of phosphorylation of kanamycin using techniques described in the literature or by testing for the presence of the mRNA coding for the NPT II gene by Northern blot analysis in RNA from the tissue of the transformed plant. Polymerase chain reactions are also used to identify the presence of a transgene or expression using reverse transcriptase PCR amplification to monitor expression and PCR on genomic DNA. Other commonly used selection markers include the ampicillin resistance gene, the tetracycline resistance and the hygromycin resistance gene. Transformed plant cells thus selected can be induced to differentiate into plant structures which will eventually yield whole plants. It is to be understood that a selection marker gene may also be native to a plant.

Transformation

Numerous methods for plant transformation have been developed, including biological and physical, plant transformation protocols. See, for example, Miki et al., "Procedures for Introducing Foreign DNA into Plants" in *Methods in Plant Molecular Biology and Biotechnology*, Glick, B. R. and Thompson, J. E. Eds. (CRC Press, Inc., Boca Raton, 1993) pages 67-88. In addition, expression vectors and in vitro culture methods for plant cell or tissue transformation and regeneration of plants are available. See, for example, Gruber et al., "Vectors for Plant Transformation" in *Methods in Plant Molecular Biology and Biotechnology*, Glick, B. R. and Thompson, J. E. Eds. (CRC Press, Inc., Boca Raton, 1993) pages 89-119.

A. *Agrobacterium*-mediated Transformation

One method for introducing an expression vector into plants is based on the natural transformation system of *Agrobacterium*. See, for example, Horsch et al., *Science* 227: 1229 (1985). *A. tumefaciens* and *A. rhizogenes* are plant pathogenic soil bacteria which genetically transform plant cells. The Ti and Ri plasmids of *A. tumefaciens* and *A. rhizogenes*, respectively, carry genes responsible for genetic transformation of the plant. See, for example, Kado, C. I., *Crit. Rev. Plant. Sci.* 10:1 (1991). Descriptions of *Agrobacterium* vector systems and methods for *Agrobacterium*-mediated gene transfer are provided by Gruber et al., supra, Miki et al., supra, and Moloney et al., *Plant Cell Reports* 8: 238 (1989). See also, U.S. Pat. No. 5,563,055, (Townsend and Thomas), issued Oct. 8, 1996.

B. Direct Gene Transfer

Several methods of plant transformation, collectively referred to as direct gene transfer, have been developed as an alternative to *Agrobacterium*-mediated transformation. A generally applicable method of plant transformation is microprojectile-mediated transformation wherein DNA is carried on the surface of microprojectiles measuring 1 to 4 μm. The expression vector is introduced into plant tissues with a biolistic device that accelerates the microprojectiles to speeds of 300 to 600 m/s which is sufficient to penetrate plant cell walls and membranes. Sanford et al., *Part. Sci. Technol.* 5: 27 (1987), Sanford, J. C., *Trends Biotech.* 6: 299 (1988), Klein et al., *Bio/Technology* 6: 559-563 (1988), Sanford, J. C., *Physiol Plant* 79: 206 (1990), Klein et al., *Bio/technology* 10: 268 (1992). See also U.S. Pat. No. 5,015,580 (Christou, et al), issued May 14, 1991; U.S. Pat. No. 5,322,783 (Tomes, et al.), issued Jun. 21, 1994.

Another method for physical delivery of DNA to plants is sonication of target cells. Zhang et al., Bio/Technology 9: 996 (1991). Alternatively, liposome or spheroplast fusion have been used to introduce expression vectors into plants. Deshayes et al., *EMBO J.,* 4: 2731 (1985), Christou et al., *Proc Natl. Acad. Sci. U.S.A.* 84: 3962 (1987). Direct uptake of DNA into protoplasts using CaCl2 precipitation, polyvinyl alcohol or poly-L-ornithine have also been reported. Hain et al., *Mol. Gen. Genet.* 199: 161 (1985) and Draper et al., *Plant*

*Cell Physiol.* 23: 451 (1982). Electroporation of protoplasts and whole cells and tissues have also been described. Donn et al., In Abstracts of VIIth International Congress on Plant Cell and Tissue Culture IAPTC, A2-38, p 53 (1990); D'Halluin et al., *Plant Cell* 4: 1495-1505 (1992) and Spencer et al., *Plant Mol. Biol.* 24: 51-61 (1994).

Following transformation of soybean target tissues, expression of the above-described selectable marker genes allows for preferential selection of transformed cells, tissues and/or plants, using regeneration and selection methods now well known in the art.

It is often desirable to have the DNA sequence in homozygous state which may require more than one transformation event to create a parental line, requiring transformation with a first and second recombinant DNA molecule both of which encode the same gene product. It is further contemplated in some of the embodiments of the process of the invention that a plant cell be transformed with a recombinant DNA molecule containing at least two DNA sequences or be transformed with more than one recombinant DNA molecule. The DNA sequences or recombinant DNA molecules in such embodiments may be physically linked, by being in the same vector, or physically separate on different vectors. A cell may be simultaneously transformed with more than one vector provided that each vector has a unique selection marker gene. Alternatively, a cell may be transformed with more than one vector sequentially allowing an intermediate regeneration step after transformation with the first vector. Further, it may be possible to perform a sexual cross between individual plants or plant lines containing different DNA sequences or recombinant DNA molecules preferably the DNA sequences or the recombinant molecules are linked or located on the same chromosome, and then selecting from the progeny of the cross, plants containing both DNA sequences or recombinant DNA molecules.

Expression of recombinant DNA molecules containing the DNA sequences and promoters described herein in transformed plant cells may be monitored using Northern blot techniques and/or Southern blot techniques known to those of skill in the art.

The transformed cells may then be regenerated into a transgenic plant. The regenerated plants are transferred to standard soil conditions and cultivated in a conventional manner.

After the expression or inhibition cassette is stably incorporated into regenerated transgenic plants, it can be transferred to other plants by sexual crossing. Any of a number of standard breeding techniques can be used, depending upon the species to be crossed.

It may be useful to generate a number of individual transformed plants with any recombinant construct in order to recover plants free from any position effects. It may also be preferable to select plants that contain more than one copy of the introduced recombinant DNA molecule such that high levels of expression of the recombinant molecule are obtained.

As indicated above, it may be desirable to produce plant lines which are homozygous for a particular gene. In some species this is accomplished rather easily by the use of anther culture or isolated microspore culture. This is especially true for the oil seed crop *Brassica napus* (Keller and Armstrong, Z. flanzenzucht 80:100-108, 1978). By using these techniques, it is possible to produce a haploid line that carries the inserted gene and then to double the chromosome number either spontaneously or by the use of colchicine. This gives rise to a plant that is homozygous for the inserted gene, which can be easily assayed for if the inserted gene carries with it a suitable selection marker gene for detection of plants carrying that gene. Alternatively, plants may be self-fertilized, leading to the production of a mixture of seed that consists of, in the simplest case, three types, homozygous (25%), heterozygous (50%) and null (25%) for the inserted gene. Although it is relatively easy to score null plants from those that contain the gene, it is possible in practice to score the homozygous from heterozygous plants by southern blot analysis in which careful attention is paid to the loading of exactly equivalent amounts of DNA from the mixed population, and scoring heterozygotes by the intensity of the signal from a probe specific for the inserted gene. It is advisable to verify the results of the southern blot analysis by allowing each independent transformant to self-fertilize, since additional evidence for homozygosity can be obtained by the simple fact that if the plant was homozygous for the inserted gene, all of the subsequent plants from the selfed seed will contain the gene, while if the plant was heterozygous for the gene, the generation grown from the selfed seed will contain null plants. Therefore, with simple selfing one can easily select homozygous plant lines that can also be confirmed by southern blot analysis.

Creation of homozygous parental lines makes possible the production of hybrid plants and seeds which will contain a modified protein component. Transgenic homozygous parental lines are maintained with each parent containing either the first or second recombinant DNA sequence operably linked to a promoter. Also incorporated in this scheme are the advantages of growing a hybrid crop, including the combining of more valuable traits and hybrid vigor.

The nucleotide constructs of the invention also encompass nucleotide constructs that may be employed in methods for altering or mutating a genomic nucleotide sequence in an organism, including, but not limited to, chimeric vectors, chimeric mutational vectors, chimeric repair vectors, mixed-duplex oligonucleotides, self-complementary chimeric oligonucleotides, and recombinogenic oligonucleobases. Such nucleotide constructs and methods of use, such as, for example, chimeraplasty, are known in the art. Chimeraplasty involves the use of such nucleotide constructs to introduce site-specific changes into the sequence of genomic DNA within an organism. See, U.S. Pat. Nos. 5,565,350; 5,731,181; 5,756,325; 5,760,012; 5,795,972; and 5,871,984; all of which are herein incorporated by reference. See also, WO 98/49350, WO 99/07865, WO 99/25821, and Beetham et al. (1999) *Proc. Natl. Acad. Sci. USA* 96:8774-8778; herein incorporated by reference.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims. Thus, many modifications and other embodiments of the invention will come to mind to one skilled in the art to which this invention pertains having the benefit of the teachings presented in the foregoing descriptions and the associated drawings. Therefore, it is to be understood that the invention is not to be limited to the specific embodiments disclosed and that modifications and other embodiments are intended to be included within the scope of the appended claims.

The following examples are offered by way of illustration and not by way of limitation.

DETAILED DESCRIPTION OF THE PREFERRED EMBODIMENT

Example 1

Materials and Methods

Growing of soybean and *Phytophthora sojae*: inoculation and disease scoring:

Soybean seedlings were grown under light conditions for two weeks (Bhattacharyya and Ward, 1986). *P. sojae* race 1 was grown in the dark at 22° C. and zoospores were obtained from 6-day-old cultures (Ward et al., 1979). Segregating materials from the cross between the pair of near-isogenic lines (NILs) ‘Elgin’ and ‘Elgin 87’ were tested for their responses to *P. sojae* race 1 by inoculating detached leaves with zoospores suspensions (Bhattacharyya and Ward, 1986). Unifoliate leaves of two-week-old $F_2$ seedlings were detached and placed in Petri plates carrying Whatman filter papers moistened in 10 ml water. Petioles of leaves were kept under a film of water and leaf blades were inoculated with drops of 10 μl zoospores suspensions carrying about 1000 zoospores. The infected leaves were scored for disease development 3 and 5 day following inoculation. Susceptible responses are characterized by rapidly spreading light-brown lesions. Resistant symptoms are normally dark brown necrotic lesions about the size of inoculum droplets. Occasionally a little spread was seen during the first three days, but the spreading lesions were dark brown.

Analysis of Segregants and Identification of Recombinants:

Five molecular markers BAC(1+2), CG1, TC1, Tgmr and TC1-F were used in isolating and characterizing recombinants. Four of these markers were described earlier (Kasuga et al., 1997). BAC120(1+2) is a cleaved amplified polymorphic marker (CAP; (Konieczny and Ausubel, 1993). It was developed by BclI digestion of PCR products representing a two kb single copy sequence, identified from BAC120. Tgmr is a dominant marker, and was developed by using primers specific to the sequences of the Tgmr target site and Tgmr.

To identify a recombinant carrying a chromosomal breakpoint in TC1-CG1 interval 979 $F_2$ plants developed from the cross between the pair of NILs Elgin and Elgin 87 were screened for disease phenotypes, and 240 susceptible plants were considered for further investigation. Approximately equal amounts of leaf samples were mixed from three susceptible plants to obtain 80 pools from 240 plants. Twelve micrograms DNA from each pool were digested with BglII and Southern blot analyses were carried out for CG1 and TC1. A single recombinant 910 (R910) was identified from this screen. To confirm the homozygosity of R910 Southern analysis was carried out using both BAC120(1+2) and TC1-F probes. Homozygous R910 is susceptible to *P. sojae* race 1 and carries both Elgin- and Elgin 87-specific TC1 alleles. Therefore, in R910 a breakpoint is located in between TC1 allelomorphs of rps1-k and Rps1-k haplotypes. The TC1-F marker was revealed by the TaqI digested genomic DNA hybridized to the TC1 probe, while BAC120(1+2) was by BclI digested DNA hybridized to the BAC120(1+2) probe. None of the susceptible plants showed any recombination between Rps1-k and BAC120(1+2).

A recombinant between Rps1-k and BAC120(1+2) was identified as follows. Eight hundred and sixty two $F_2$ plants were evaluated for disease phenotypes and markers BAC120 (1+2) and Tgmr. Candidate recombinants were transferred to the greenhouse for generating $F_3$ seeds. Progeny testing of the candidate recombinants for disease phenotypes and RFLP patterns of BAC120(1+2), CG1, TC1 and TC1-F resulted in the identification of the recombinant 213 (R213), which is recessive homozygous for BAC120(1+2), but heterozygous for CG1, Rps1-k, TC1 and TC1F. Therefore, a recombination breakpoint is located between BAC120(1+2) and CG1 in R213.

DNA preparation, PCR and Southern analyses: Soybean genomic DNA was prepared from leaves of selected individual plants or pools of three plants according to White and Kaper (White and Kaper, 1989). A touchdown PCR program with initial denaturing temperature of 94° C. for 2 minutes, and then denaturing temperature of 94° C. for 30 sec at the beginning of each cycle, annealing temperature dropping from 60° C. to 55° C.@−1° C./cycle, and extension temperature of 72° C. for 1 min/cycle was used. A total of 35 cycles were carried out with the final annealing temperature 55° C. Southern analysis was carried out according to the protocol described earlier (Kasuga et al., 1997).

Linkage analysis: In the isolation of R910 a total of 480 chromatids were evaluated, whereas for R213 1724 chromatids were analyzed. Genetic distances between Rps1-k and TC1, and Rps1-k and BAC120(1+2), were calculated by using the Map Manager program (Manly and Cudmore, 1995).

Preparation of high molecular weight (HMW) DNA and construction of a BAC library: Williams 82 plants were grown in growth chambers under standard growing conditions (Bhattacharyya and Ward, 1986; Kasuga et al., 1997). HMW DNA from young unifoliate leaves of Williams 82 was prepared following the protocols described earlier (Salimath and Bhattacharyya, 1999). Agarose plugs carrying approximately 8-10 μg of HMW DNA were prepared (761 μl volume). About 150 plugs were prepared in a single batch and tested for quality by digesting the DNA with HindIII in the presence or absence of magnesium chloride. The plugs were sent to GenomicSystems, Inc. (St. Louis) for construction of a BAC library in the pBeloBAC11 vector (Kim et al., 1996). A copy of the library and sets of DNA filters carrying DNA samples from individual BAC clones were obtained from GenomicSystems, Inc. and used in the present investigation. Analyses of BAC clones were carried out according to Salimath and Bhattacharyya (1999).

Subcloning and sequencing of BAC clones: Three overlapping BAC clones, BAC18, BAC43 and BAC99 carrying the Rps1-k locus were sequenced using a shot-gun approach. To minimize *E. coli* DNA contamination, DNA of the three BAC clones was prepared with Qiagen Large Construct Kit (Qiagen, Valencia, Calif.). Two shotgun libraries for each BAC clone were constructed. One library was made using Topo shotgun subcloning kit (Invitrogen, Carlsbad, Calif.). Briefly, individual BAC DNA was nebulized under 5 psi for 10 seconds. Fragments of 5 to 10 kb were blunt-ended, dephosphorylated and ligated to vector pCR4BluntTOPO. For the other library, DNA of each BAC was partially digested with Sau3AI, DNA fragments around 20 kb were purified and then ligated into the dephosphorylated BamHI restriction site of the binary vector pTF101.1 and pTF101.1 clones were obtained. Colonies were picked randomly and stored in 96-well microtiter plates. Plasmid DNA was prepared applying Montage plasmid Miniprep Kit (Millipore, Bedford, Mass.). DNA sequencing was run on ABI PRISM 3700 Analyzer by the DNA sequencing facility at Iowa State University. The sequence data were assembled using Phred/Phrap software on a Linux computer. The resulted contigs of each BAC were ordered into scalffold manually using the read pairs. Primer walking was applied to fill in the remaining gaps. The assembled sequences were searched against GenBank using the BlastX algorithm (www.ncbi.nlm.gov). Four NBS-LRR-type genes were identified. A series of primers for both strands were designed in every 200-300 bp from the consensus sequence of the four NBS-LRR sequences.

Sequencing and sequence Analysis of NBS-LRR clones: The pTF101.1 clones used for sequencing were hybridized to NBS or/and LRR probes. The positive clones were then classified into seven putative groups by DNA finger-printing. At least one clone from each group and a total of 13 clones were sequenced using primers designed based on the consensus NBS-LRR sequence. Each nucleotide was sequenced at least three times. The sequence reads of each clone were assembled using Vector NTI (Suite 6) program. The gene structure was predicted with Genscan (www/gemes/,ot/edi-GENSCAN.html).

cDNA cloning: Upper ⅓$^{rd}$ portion of the etiolated hypocotyls of 7-day old dark grown seedlings expressing Rps genes was used to generate a cDNA library in the Uni-ZAP XR lambda vector (Stratagene, Inc., CA) (Ward et al., 1981; Bhattacharyya, 2001). About $4.6\times10^6$ plaque forming units (pfus) from this unamplified library were screened using LRR domain of the Rps1-k-1 (the LRR-Rps1-k-1 probe) gene family. Positive clones were purified and excised for sequencing.

Phosphorimage analysis and copy number estimation: To determine the copy number of LRR160-like sequences, Southern blot analysis was carried out for variable amounts of soybean genomic DNA and the pGO2 plasmid containing Rps1-k-1. The size of the insert DNA is 8.7 kb and the total size of pGO2 is 17.8 kb. Salmon sperm DNA was digested with BamHI and mixed with HindIII digested soybean genomic DNA or pGO2 DNA to adjust the amounts of all samples to 5 μg in order to avoid any variation in blotting that may otherwise arise due to differences in the amount of DNA quantities. The DNA samples were run on a 0.8% agarose gel at 20 volts for 24 h. The gel was blotted and hybridized to the ($^{32}P$)-labeled LRR-Rps1-k-1 probe and the blot was exposed to storage phosphor screen for 48 hr. The extent of hybridization of the probe to the 2.3 kb HindIII fragment was determined using a Phosphorimager (Molecular dynamics Variable mode imager-Typhoon 8600). Analysis of the phosphorimages was carried out using ImageQuant software (Tutorial version 5.0) and the volume of the each hybridizing signal was determined. Two linear graphs, one for pG02 and the other for soybean DNA, were developed using the Microsoft Excel program. Based on the linear relationships between amounts of DNA and density-volume estimation in the phosphorimager, the amounts of pGO2 and soybean DNA required for 500,000 units band intensity was 702 pg and 3.12 μg, respectively. If the soybean genome (1150 Mb; Arumuganathan and Earle, 1991) carries a single copy of this LRR sequence, then the amount of soybean DNA necessary for 500,000 units band intensity is 92.84 μg {(1150,000×702)/(8.7×1000,000)}. Therefore, the copy number of LRR sequences to produce the 2.3 kb HindIII fragment is 30 (92.84/3.12). There are 8 additional HindIII fragments that hybridize to the LRR probe in addition to the 2.3 kb fragment. Therefore, the total copy number of LRR sequence is estimated to be at least 38.

Results

Isolation of recombinants for the Rps1 region: In mapping the Rps1 region, earlier we studied segregating populations derived from three independent crosses between pairs of NILs (Kasuga et al., 1997). We observed that genotypes carrying all the recombination breakpoints mapped between Tgmr and TC1 were identified from the $F_3$ families of the cross between Williams (rps1-k) and Williams 82 (Rps1-k), whereas breakpoints of two recombinants mapped in the TC1-CG1 interval were isolated from the $F_2$s of crosses between Elgin 300 (rps1-k) and OX717 (Rps1-k), and Elgin (rps1-k) and E420 (Rps1-k) (T. Kasuga and M. K. Bhattacharyya, unpublished results). These two pairs of NILs are derivatives of the NILs Elgin and Elgin 87 (Kasuga et al., 1997). These results indicated that recombination events in the Rps1-k region are influenced by genotypes of the parents.

Figure 1:
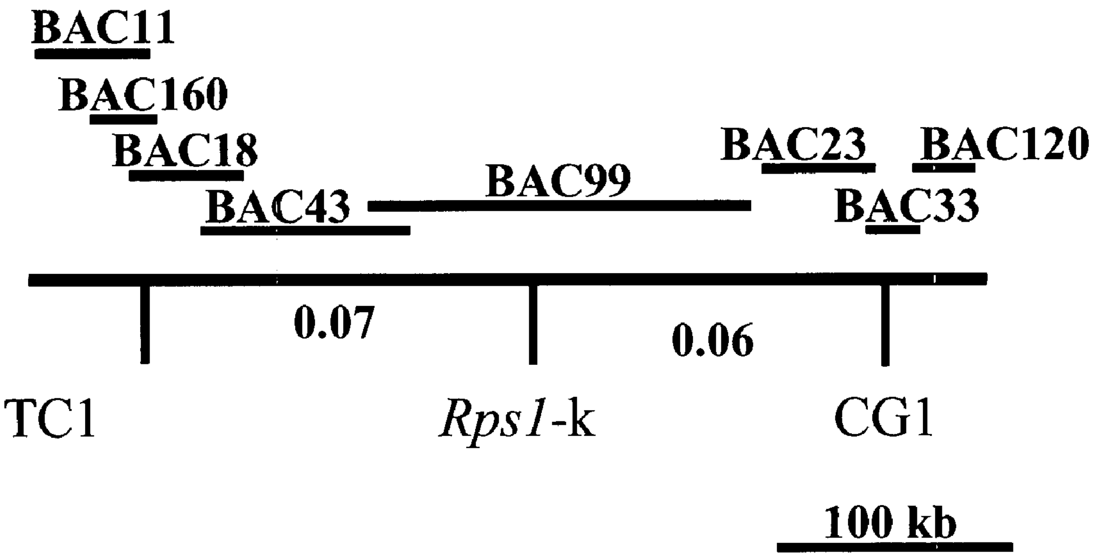
FIG. 1. A BAC contig at the Rps1-k region. Several BAC libraries carrying 24 genome equivalents were screened for AFLP markers TC1 and CG1. BAC33, BAC120 and BAC160 were obtained from a BAC library carrying five genome equivalent clones of average size ~50 kb (S. S. Salimath and M. K. Bhattacharyya, unpublished results). BAC11 and BAC23 were isolated from a separate BAC library that carries five genome equivalent clones of average size ~150 kb (Marek and Shoemaker, 1997). BAC18, 43 and 99 were isolated from a BAC library carrying 10 genome equivalent DNA clones of average size 125 kb (C. Baublite and M. K. Bhattacharyya, unpublished).

FIG. 1. A BAC contig at the Rps1-k region. Several BAC libraries carrying 24 genome equivalents were screened for AFLP markers TC1 and CG1. BAC33, BAC120 and BAC160 were obtained from a BAC library carrying five genome equivalent clones of average size ~50 kb (S. S. Salimath and M. K. Bhattacharyya, unpublished results). BAC11 and BAC23 were isolated from a separate BAC library that carries five genome equivalent clones of average size ~150 kb (Marek and Shoemaker, 1997). BAC18, 43 and 99 were isolated from a BAC library carrying 10 genome equivalent DNA clones of average size 125 kb (C. Baublite and M. K. Bhattacharyya, unpublished).

To identify more recombinants for the genomic regions flanking Rps1-k, we developed a population of over 2000 $F_2$ plants from the cross between Elgin and Elgin 87. A cleaved amplified polymorphic marker 120(1+2) was developed from a single copy sequence of BAC120. Tgmr and 120(1+2) were used to screen the $F_2$ population and, as expected, two recombinants were identified for the TC1-120(1+2) interval. Recombinant 213 (R213) carries a recombination breakpoint between CG1 and 120(1+2). Recombinant 910 (R910) carries both resistant- and susceptible-specific TC1 alleles. All $F_3$ progenies of R910 (rps1-k) were susceptible to *Phytophthora sojae* race 1 and carried both TC1-specific alleles. Presumably an unequal crossing-over event between TC1 allelomorphs-specific to the Elgin (rps1-k) and Elgin 87 (Rps1-k) haplotypes resulted in the rearrangement observed in R910. R213 was obtained from screening 1724 chromatids, whereas R910 was identified from screening 480 chromatids. Therefore, according to this study, the genetic distances between Rps1-k and 120(1+2), and TC1 and Rps1-k, are 0.06 and 0.21 cM, respectively. R910 and R213 were used in this investigation.

Figure 2:
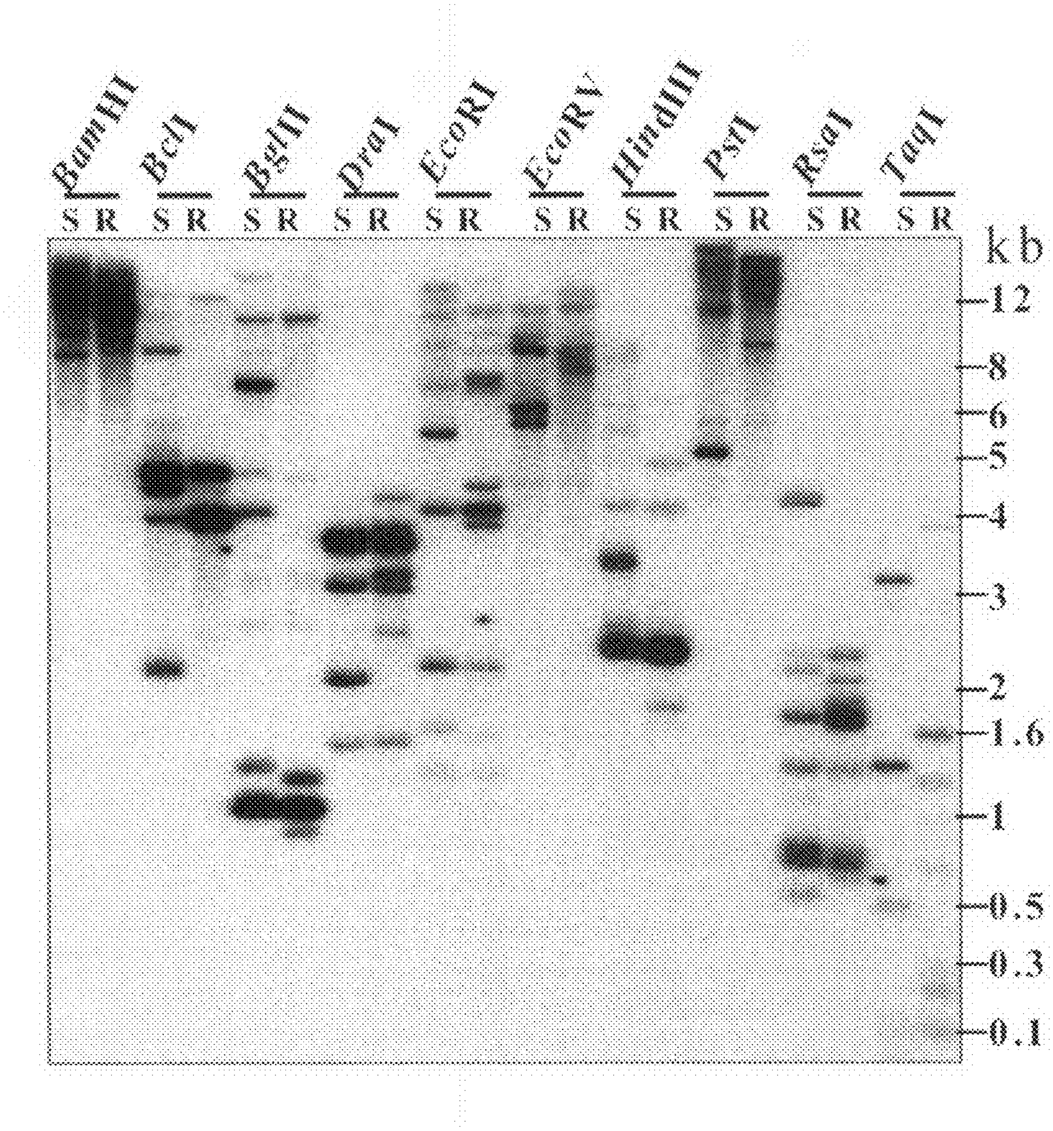
FIG. 2. LRR-160 is highly polymorphic between two near-isogenic lines (NIL) that differ for Rps1-k alleles. DNA samples from NILs Elgin (rps1-k) and Elgin 87 (Rps1-k) were digested with 10 restriction enzymes. S, Elgin; R, Elgin 87.

FIG. 2. LRR-160 is highly polymorphic between two near-isogenic lines (NIL) that differ for Rps1-k alleles. DNA samples from NILs Elgin (rps1-k) and Elgin 87 (Rps1-k) were digested with 10 restriction enzymes. S, Elgin; R, Elgin 87.

Construction of a BAC contig for the Rps1-k region: Rps1-k was mapped between TC1 and CG1 markers (Kasuga et al., 1997). To develop a contig in the Rps1-k region, a cosmid library carrying eight genome equivalents of DNA and several BAC libraries carrying 24 genome equivalents of DNA were screened and results are summarized in FIG. 1 (Bhattacharyya et al., 1997; Marek and Shoemaker, 1997; Salimath and Bhattacharyya, 1999; S. S. Salimath and M. K. Bhattacharyya, unpublished results; C. Baublite and M. K. Bhattacharyya, unpublished). These libraries were constructed using high molecular weight DNA prepared from the cultivar Williams 82. No cosmid clones containing either TC1 or CG1 were obtained. BAC33, BAC120 and BAC160 were obtained from a BAC library carrying five genome equivalents of DNA with an average insert size ~50 kb (S. S. Salimath and M. K. Bhattacharyya, unpublished results). BAC160 and BAC33 carry TC1 and CG1, respectively. BAC 11 containing TC 1 and BAC23 carrying one end of BAC33 were isolated from a separate BAC library that carries five genome equivalents of DNA (Marek and Shoemaker, 1997). The average insert size of this library is ~150 kb; but BAC11 and BAC23 carry only about 40-kb-long inserts. BAC120 was obtained from screening of a BAC library for a BAC33 end-specific probe (S. S. Salimath and M. K. Bhattacharyya, unpublished). None of these BACs contains CG1. Chromosomal walks from either BAC160 or BAC23 toward Rps1-k was not successful because of the high repetitiveness of the BAC160 and BAC23 ends that are close to the locus.

All disease resistance genes except Pto and Rpg1 carry leucine rich repeat sequences and most LRR-type disease resistance genes occur in clusters, and usually only one type of LRR gene is predominant in a given genomic region. Therefore, we hypothesized that: (i) Rps1-k is an LRR-type resistance gene, and (ii) paralogous Rps1-k sequences would be present in any of the BACs that were adjacent to Rps1-k. Identification of such sequences would then allow us to identify the BACs that carry Rps1-k. We sequenced random fragments from both BAC160 and BAC23 and identified a 2.3 kb HindIII fragment that carries an LRR sequence from BAC160. This sequence, LRR160, showed highest identity (35%) to the tomato disease resistance gene I2C-1 (Ori et al., 1997). This fragment was used to screen two libraries, one of which was constructed in collaboration with GenomeSystems, Inc. (St. Louis) (C. Baublite and M. K. Bhattacharyya, unpublished). The library comprised of 92,160 BAC clones representing 10 soybean haploid genomes. The average insert size of BAC clones of this library is about 125 kb. The other library was constructed in Shoemaker Laboratory (Marek and Shoemaker, 1997). BAC18, 43 and 99 were isolated from the new library by using the LRR160 probe. Recombinants R910 and R213 were applied to confirm the map position of these three BACs. A 1.6 kb EcoRI fragment identified from BAC43 and BAC99 was mapped to the TC1-CG1 interval. The end of BAC99, distal from BAC43 carries a retroelement sequence that is highly repeated in the soybean genome. Therefore, a chromosomal walk from BAC99 was not possible. A long-range PCR using BAC99- and BAC23-specific primers applied to amplify the DNA fragment from the gap region was also unsuccessful. We have determined the size of BAC18, 23 and 33 by separating NotI-digested BAC DNA in a CHEF gel, and DNA finger printing. BAC18, 43 and 99 were sequenced and sizes of these clones were determined from their sequences. Based on the data from these experiments the physical distance between TC1 and CG1 was determined to be about 320 kb.

LRR160-like sequences are highly repetitive and polymorphic: Southern blot analysis of near-isogenic lines Elgin and Elgin 87 using ten different restriction endonucleases indicated that the LRR160 sequence is highly repetitive and polymorphic between the two lines for all ten enzymes studied (FIG. 2). Similar results were obtained from the analysis of Williams and Williams 82. The polymorphic nature of this repeat element between pairs of near-isogenic lines differing Rps1-k indicates that most copies, if not all, must be located somewhere in the introgressed DNA fragment containing Rps1-k.

Figure 3:
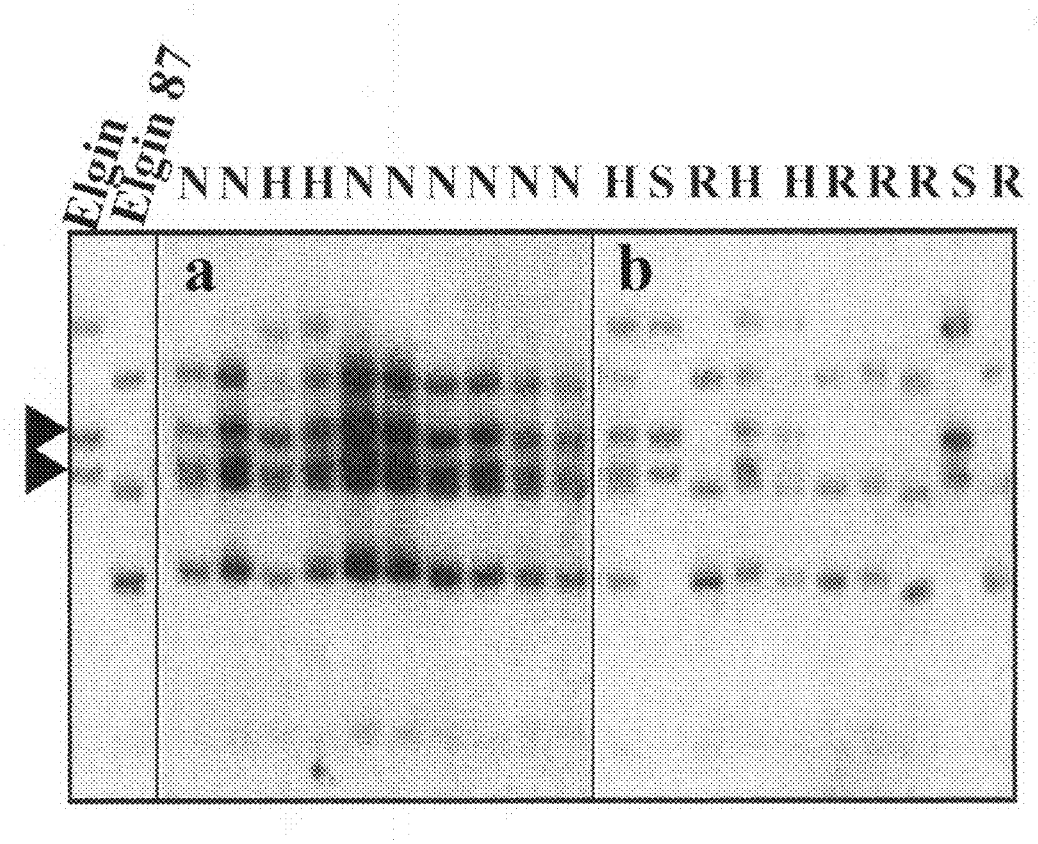
FIG. 3. Illegitimate recombination in the Rps1-k region. The BAC18 end (18R) that overlaps with BAC160 was mapped using ten $F_3$ progenies (a, lane 1-10) and ten $F_2$s (b, lane 1-10) of R910 and R213, respectively. The DNA samples were digested with BclI for this RFLP mapping experiment. R, resistant parent Elgin 87-specific genotype; S, susceptible parent Elgin-specific genotype; H, heterozygotes; N, novel genotype that carries all R-specific and two S-specific (shown by arrows) fragments. R910 contains a breakpoint in between allelomorphs of 18R and TC1.

Unequal crossing over in the Rps1-k region: In order to define the Rps1-k locus the breakpoint in R910 was investigated by using the BAC18-end (18R) that overlaps with BAC160. BclI-digested $F_3$s of R910 and $F_2$s of R213 revealed that 18R hybridized to three DNA fragments of Elgin, whereas four fragments of Elgin 87 (FIG. 3). Homozygous progenies of R910 showed a novel rearrangement for these sequences (FIG. 3*a*); two Elgin-specific fragments were observed along with all four Elgin 87-specific fragments among the unusual segregants. TC1 alleles from both rps1-k and Rps1-k haplotypes were also fixed among homozygous progenies of R910 (data not shown). Both TC1 and 18R sequences segregate normally among progenies of the heterozygous R213 (FIG. 3*b*). Multi-copy TC1 and 18R are physically linked and novel rearrangements for these two markers among progenies of R910 were resulted in presumably from of unequal crossing-over event. The mapping of 18R confirmed that BAC43, 18 and 99 but not 160 are from the genomic region that carries Rps1-k. We conclude that the Rps1-k locus spans between 18R and CG1.

FIG. 3. Illegitimate recombination in the Rps1-k region. The BAC18 end (18R) that overlaps with BAC160 was mapped using ten $F_3$ progenies (a, lane 1-10) and ten $F_2$s (b, lane 1-10) of R910 and R213, respectively. The DNA samples were digested with BclI for this RFLP mapping experiment. R, resistant parent Elgin 87-specific genotype; S, susceptible parent Elgin-specific genotype; H, heterozygotes; N, novel genotype that carries all R-specific and two S-specific (shown by arrows) fragments. R910 contains a breakpoint in between allelomorphs of 18R and TC1.

Identification of a cluster of 160LRR-like sequences in the Rps1-k region: In order to study (i) if the candidate LRR sequence is also present in BAC23 and 33 and (ii) the organization of the sequence around the Rps1 region Southern blot analysis was carried using the contiguous BAC clones of the Rps1-k region shown in FIG. 4A. BAC92 and BAC95 were reported earlier (Salimath and Bhattacharyya, 1999). BAC70 was identified from a library constructed in Bhattacharyya Lab by using a BAC92-end-specific probe (Salimath and Bhattacharyya, 1999). BAC212 was identified from a library constructed in Shoemaker Lab (Marek and Shoemaker, 1997). The other BACs are presented in FIG. 1. The LRR160-like sequences are absent in BAC23, 33 and 120 (FIG. 4B). Several copies were however identified on the other side of the Rps1-k locus.

Figure 4:
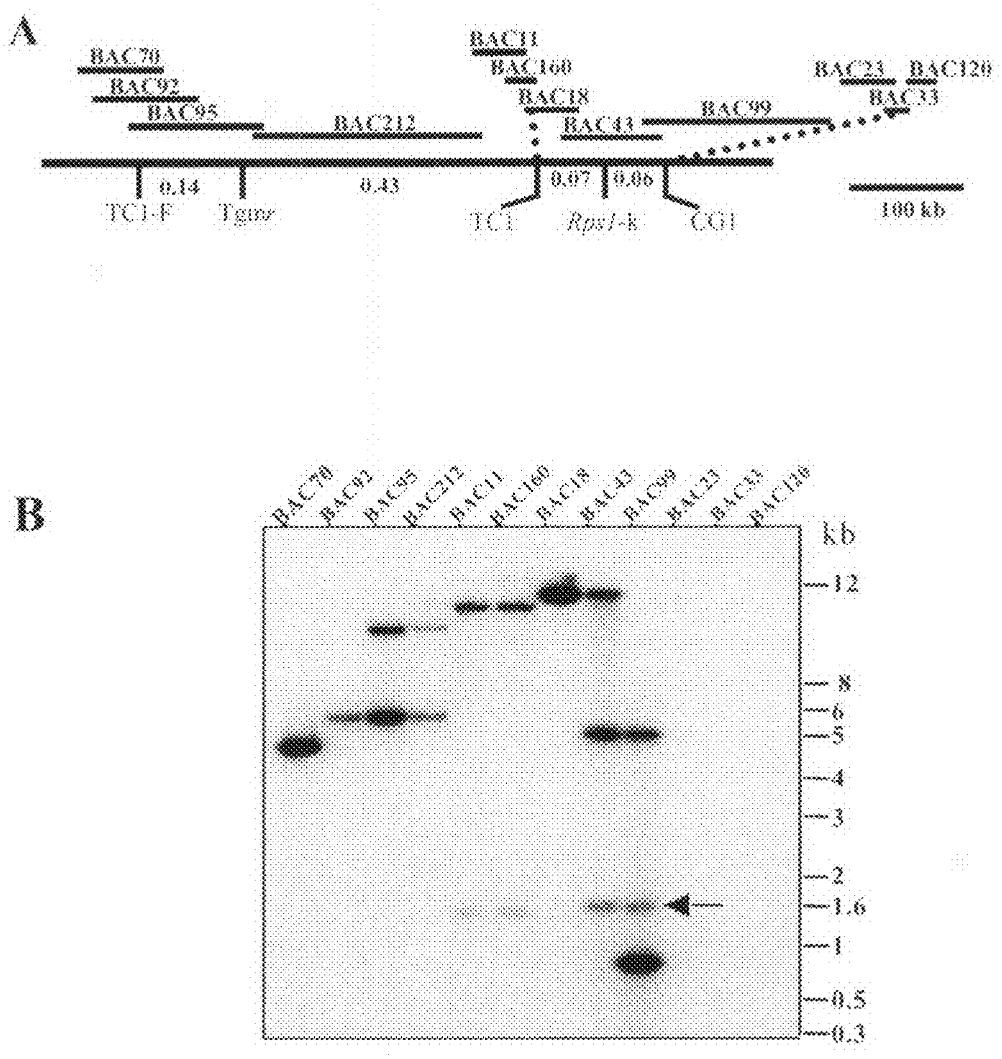
FIG. 4. Identification of a cluster of LRR160-like sequences from the Rps1-k region. A, BAC clones that cover the region spanning from TC1-F to 120(1+2). B, BAC clones shown in A were digested with EcoRI and hybridized to LRR160. LRR160-like sequences were observed from the Rps1-k region to the TC1-F marker. No sequences from BAC23, 33 and 120 hybridized to the probe. The 1.6 kb EcoRI fragment showed by an arrow co-segregates with the Rps1-k locus.
Figure 5:
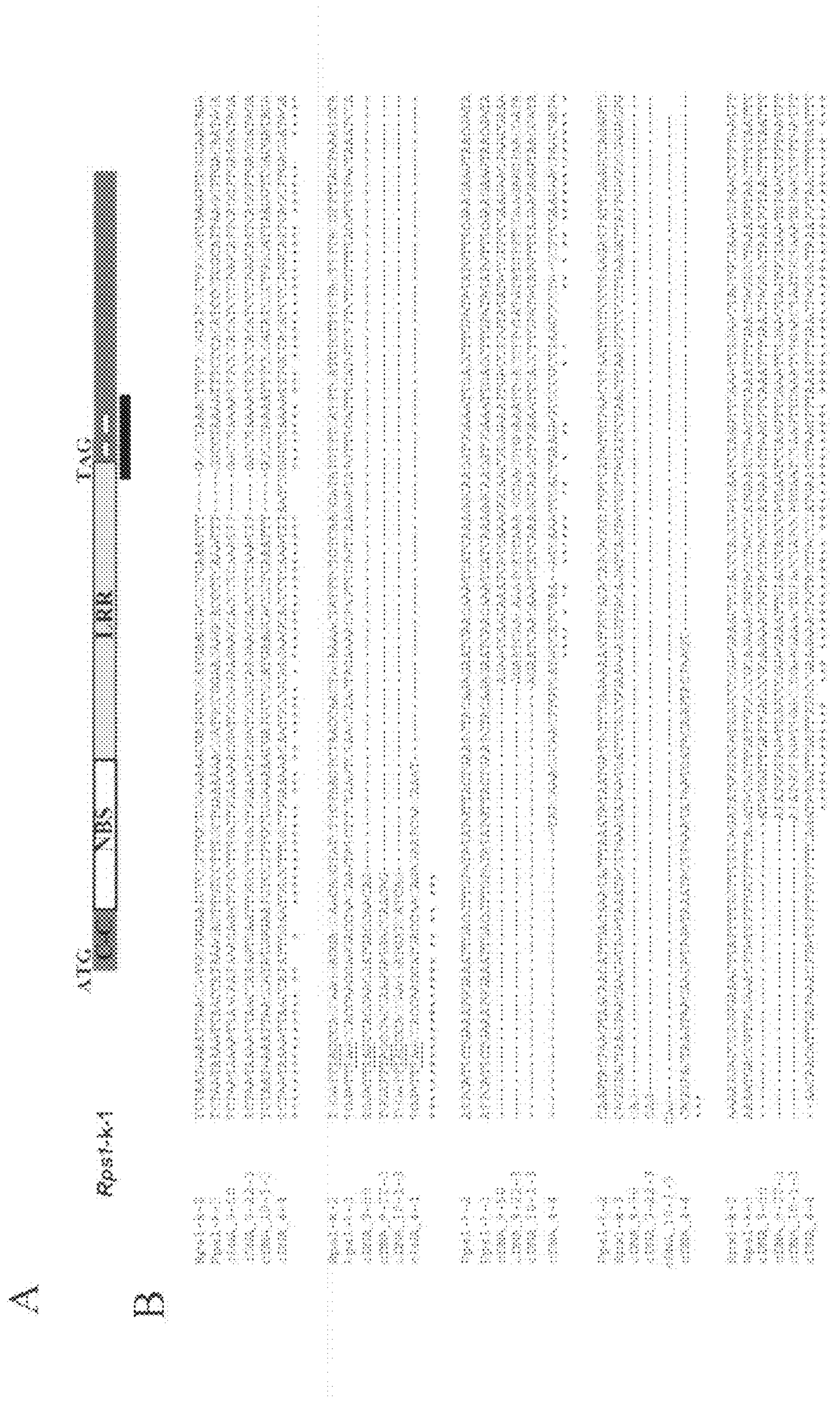
FIG. 5. Comparison of cDNA sequences with members of the candidate Rps1-k gene family. A, Structure of a LRR sequence identified from the Rps1-k locus is shown. C-C, coiled coild domain; NBS, nucleotide binding site domain; LRR, leucing rich repeat region. Two white rectangles just after TAG are introns. The black bar indicates the region used to compare sequences of two classes of genes from the Rps1-k locus with that of cDNAs isolated in this investigation. B, Comparison of candidate Rps1-k gene sequences cCDNA_p50 cDNA__10-1-3; cDNA 4-4 as set forth in SEQ ID NOS:155-158 respectively with cDNA sequences. Rps1- k-2 (SEQ ID NO:153) and Rps1-k-3 (SEQ ID NO:154) represent two classes of identical genes isolated from the Rps1-k locus.

FIG. 4. Identification of a cluster of LRR160-like sequences from the Rps1-k region. A, BAC clones that cover the region spanning from TC1-F to 120(1+2). B, BAC clones shown in A were digested with EcoRI and hybridized to LRR160. LRR160-like sequences were observed from the Rps1-k region to the TC1-F marker. No sequences from BAC23, 33 and 120 hybridized to the probe. The 1.6 kb EcoRI fragment showed by an arrow co-segregates with the Rps1-k locus.

FIG. 5. Comparison of cDNA sequences with members of the candidate Rps1-k gene family. A, Structure of a LRR sequence identified from the Rps1-k locus is shown. C-C, coiled coild domain; NBS, nucleotide binding site domain; LRR, leucing rich repeat region. Two white rectangles just after TAG are introns. The black bar indicates the region used to compare sequences of two classes of genes from the Rps1-k locus with that of cDNAs isolated in this investigation. B, Comparison of candidate Rps1-k gene sequences cCDNA_9-50, cDNA-10-1-3; cDNA_4-4 as set forth in SEQ ID NO:S155-158 respectively with cDNA sequences. Rps1-k-2 (SEQ ID NO:153) and Rps1-k-3 (SEQ ID NO:154) represent two classes of identical genes isolated from the Rps1-k locus.

DNA samples of BAC18, 43 and 99 were partially digested with Sau3A and about 15-20 kb fragments were cloned into the binary vector pTF101.1 (Frame et al., 2002) and 768 clones (referred to pTF101.1 clone) were picked and both ends of inserts were sequenced. Shot gun sequencing of BAC18, 43 and 99 were also carried out to identify all possible LRR160-like sequences from the Rps1-k locus. Based on (i) random sequencing of BAC18, 43 and 99, and (ii) complete sequencing ORFs of 13 pTF101.1 clones representing seven classes of LRR160-like sequences revealed that there are at least five distinct LRR-containing genes in a cluster around BAC43. No second type of LRR sequences or any other potential open reading frames for Rps1-k was detected from sequences of BAC18, 43 and 99. These five genes Rps1-k-1, -2, -3, -4 and -5, the candidate Rps1-k gene family, form two classes. Between members of the two classes 93% and 89% identity were observed at the nucleic acid and amino acid levels, respectively. Members from each class showed 100% identity at both nucleic acid and amino acid levels.

Expression of the gene family in tissues expressing Rps1-k-specific resistance: A cDNA cloning approach was applied to investigate the transcripts of the candidate Rps1-k gene family. The Rps gene-specific resistance is expressed in upper ⅓$^{rd}$ portion of etiolated soybean hypocotyls (Ward et al., 1981). A total of $4.6\times10^6$ plaque forming units (pfus) from an unamplified cDNA library constructed from the ⅓$^{rd}$ portion of etiolated soybean hypocotyls were screened using the LRR domain of a candidate Rps1-k-1 gene (pG02). Seven cDNAs, representing four classes of genes, with high identity to the candidate Rps1-k gene family were isolated from the cDNA screening experiments. Comparison of nucleotide sequences of one member from each class of cDNAs with that of one member from each class of the candidate Rps1-k gene family showed that none of the cDNAs showed 100% identity with any member of the candidate Rps1-k gene family (FIG. 5). Two introns were identified at the 3'-untranslated region of the candidate Rps1-k gene family. These results indicate that (i) four members of the LRR-gene family discovered in this investigation transcribed to a detectable level (transcript level $\sim4.7\times10^{-7}$), and (ii) transcripts of the candidate Rps1-k gene family is not detectable by the cDNA cloning strategy.

FIG. 6. Copy number of the LRR sequences. (A) Phosphoimage of a Southern blot carrying HindIII digested plasmid pGO2 DNA (a, 5,700 pg; b, 3,800 pg; c, 3,325 pg; d, 2,850 pg; e, 2,375 pg; f, 1,990 pg; g, 1,710 pg; h, 1,520 pg; I, 1,330 pg; j, 1,140 pg; k, 950 pg; 1, 760 pg; m, 570 pg; n, 380 pg; o, 190 pg) and soybean genomic DNA (1, 1 μg; 2, 2 μg; 3, 3 μg; 4, 4 μg; and 5, 5 μg) samples hybridized to pGO2-specific LRR sequence. (B) Linear relationship between intensity of hybridization signals (volume) and adjusted concentration of pGO2 DNA content. Values shown in A are adjusted by subtracting the DNA contents for the 9.1 kb pTF101.1 vector. For example, adjusted values for a, b and o are 2770, 1847 and 92 pg, respectively. (C) Linear relationship between intensity of hybridization signals (volume) and concentrations of soybean genomic DNA in picograms.

FIG. 7. Mapping of the LRR sequences using near-isogenic lines. (A) Genotype of NILs used in mapping LRR160 are shown against a genetic map of the Rps1-k region. Dark lines represent DNA from the introgressed region carrying Rps1-k. Faint lines represent the DNA from susceptible lines. (B) Southern blot of TaqI digested genomic DNA was hybridized to the pGO2-specific LRR probe and arrows are used to show the LRR sequences mapped to different loci shown in FIG. 7D. Arrows show the Williams 82-specific fragments that disappeared in the recombinant lines due to exchange of DNA strands between parents. For example, the LRR-a fragment is missing from all recombinant lines except R910 or R213 (data not presented). Therefore, this locus was mapped in between recombination break points of R910 and R1-02. In the first panel a heterozygote R1-02 recombinant genotype (R1-02{Hetero}) is included to show that this recombinant received the Williams-specific fragment LRR-b not the LRR-a, which is slightly smaller than LRR-b. LRR-c is missing in all recombinants except in R1-02 (FIGS. 7B-*a*), R910 and R213. Therefore, the LRR-c locus mapped in between the breakpoints of R-02 and R4-55. LRR-d and -e are missing in R4-62, and instead, two Williams-specific fragments LRR-e and -f were observed in this recombinant. Therefore, these fragments were mapped in between breakpoints of R2-15 and R4-62. LRR1, -2, and -3 are mnomorphic and could not be mapped. DraI-digested DNA revealed that the Williams 82-specific pA280 allele (shown by arrow in FIGS. 7C-*a*) is missing in Flyer, therefore, this line carries a breakpoint between Tgmr and pA280. Flyer carries all the LRR sequences observed in Resnik and a fragment-specific to A3127 (shown by arrows in FIGS. 7C-*b*). TaqI-digested DNA (FIGS. 7C-*c*) supported the results observed for DraI digested DNA that was probed with the LRR probe (FIGS. 7C-*b*). Flyer carries two A3127 (recurrent parent)-specific TaqI fragments LRR-i and -k in addition to all LRR sequences from the donor parent Williams 82 (FIGS. 7C-*c*). LRR sequences specific to A3127 observed in Flyer but not in Resnik were mapped to the pA280 locus tentatively. These sequences can, however, be mapped to a locus (loci), south of pA280. Polymorphic fragments LRR-h and -j-specific to Williams 82 were found in Flyer and also in R213 that does not carry any Williams 82 specific DNA beyond CG1 {breakpoint between CG1 and 120(1+2)}. These sequences were also found in other recombinants. Therefore, these were mapped between breakpoints of Flyer and R4-62.

Candidate Rps1-k genes are members of a large family of resistance gene-like sequences: Plant disease resistance genes commonly occur in clusters. For example the Dm3 gene cluster carries 24 copies in the lettuce genome (Meyers et al., 1998; Chin et al., 2001). Southern analysis of LRR160 revealed that the sequence is highly repetitive. EcoRI and TaqI digestions released many polymorphic DNA fragments between the two lines. To the contrary, the HindIII digestion produced one intensely hybridizing and eight additional DNA bands. The 2.3 kb intense band represents a group of HindIII fragments that are conserved among most copies of the repeat element (FIG. 2). We carried out a Southern blot experiment in order to estimate the copy number of the repeat sequences in the intensely hybridizing HindIII fragment. Soybean genomic DNA along with plasmid pGO2 DNA carrying a member of the candidate Rps1-k gene family were digested completely with HindIII and separated in an agarose gel. Blot of these DNA samples was hybridized to the pGO2-specific LRR probe and analyzed using a phosphoimager (FIG. 6). The copy number for LRR-like sequences in the soybean genome was calculated by comparing the band intensity of the 2.3 kb HindIII genomic fragment with that of the 2.3 kb HindIII plasmid pG02-specific fragment. This comparative analysis indicated that the intensely hybridizing 2.3 kb HindIII fragment could represent about 30 copies. Therefore, the total members of this class of LRR-type sequences in the soybean genome could be about 38.

Organization of the related members of the candidate Rps1-k gene family: The organization of members of the LRR sequences discovered in this investigation was studied by high resolution mapping of the sequence with the aid of near-isogenic lines that contain recombination breakpoints in the Rps1-k region. Homozygous recombinants R1.02, R2.15, R4.55, and R4.62 carrying recombination breakpoints between Rps 1-k and TC1-F, were identified in our previous study (Kasuga et al., 1997). These lines were selfed to obtain homozygous lines with breakpoints in the TC1-F and Rps1-k interval (Kasuga et al., 1997). Sister lines Flyer and Resnik were developed by introgressing Rps1-k from Williams 82 into the cv. A3127. Earlier we detected a recombination breakpoint between the marker pA280 and Rps 1-k in Flyer but not in Resnik (Bhattacharyya et al., 1997). Therefore, Flyer does not carry the Williams 82-specific allele of pA280. Hence, these three lines were also included in this study. The chromosomal breakpoints in these near-isogenic lines are shown in FIG. 7A. The genetic distance between Rps1-k and pA280 is about 3 cM (Bhattacharyya et al., 1997; Kasuga et al., 1997). Southern blot analysis of these lines revealed that most members of the LRR sequences of the Rps1-k haplotype are distributed over a small genomic region encompassing Rps1-k and pA280. In this interval all Williams 82-specific LRR-like sequences except three monomorphic TaqI fragments were mapped to six distinct loci including Rps1-k and LRR160 (FIG. 7D). Some rps1-k haplotype-specific TaqI fragments such as LRR-i and k were putatively mapped to the pA280 locus (FIG. 7D).

Discussion

As a first step toward understanding the molecular basis of the soybean-*Phytophthora sojae* interaction, we applied a map-based cloning approach to isolate the most stable and widely used *Phytophthora* resistance gene Rps1-k. In the Rps1 locus five functional genes; Rps1-a, -b, -c, -d and -k were genetically mapped. In this article we describe the positional cloning, expression and organization of a family of highly repetitive coiled-coil NBS-LRR-type disease resistance sequence, at least five members of which are the only R-gene-like sequences present in the Rps1 locus.

The Rps1-k locus mapped to a recombination-suppressed region: The high resolution map published earlier showed that the genetic distance between TC1-F and CG1 is 0.7 cM (Kasuga et al., 1997). Based on the contig presented in FIG. 4 the physical distance between TC1-F and CG1 is about 670 kb and contains a gap. Therefore, average physical distance/cM in the TC 1-F and CG1 interval is about 1 Mb/cM. We observed a variation in the recombination rates in this region. Between TC1-F and TC1 markers, the physical and genetic distances are ~350 kb and 0.57 cM, respectively, and therefore, a relationship of ~615 kb/cM is observed. The genetic and physical distances between TC 1 and CG 1 are 0.13 cM and -320 kb, respectively, and therefore, a relationship of about 2.5 Mb/cM was calculated for the TC1-CG1 interval carrying the Rps1-k gene. In soybean the total genetic map distance is 3000 cM, genome size is about 1150 megabases and the average physical distance/cM for the whole genome is about 383 kb/cM (Arumuganathan and Earle, 1991; Cregan et al., 1999). Considering these estimates, over six-fold reduction in the recombination rate for the Rps1-k region as compared to that in the whole genome was observed.

A suppression of recombination frequency in the Rps1-k region as compared to that in the rest of the genome could be due to divergence of this region between the Rps1-k and rps1-k haplotypes. Alternatively the region could be located near a heterochromatic area. Recombination frequencies in genomic regions carrying disease resistance genes are suppressed in many crop species (van Daelen et al., 1993; Ganal and Tanksley, 1996; Wei et al., 1999; Chin et al., 2001). On the contrary, enhanced recombination rates have been also reported for regions carrying other resistance genes (Collins et al., 1999; Graham et al., 2000; Deslandes et al., 2002). Recombination rates tend to vary several folds throughout the genome with higher rates of recombination in the euchromatic regions and much lower rates in the heterochromatic regions including centromeres (Tanksley et al., 1992; Sandhu and Gill, 2002). Tomato resistance gene Mi was introgressed from *Lycopersicon peruvianum*, and suppression of recombination in the Mi region is considered to be the result of alien origin of the introgressed fragment and also proximity of the gene to the cetromere (Kaloshian et al., 1998). The barley Mla6 allele of the Mla cluster was introgressed from a wild relative and suppression of recombination is considered to be due to the high rate of polymorphisms at the Mla cluster (Wei et al., 1999). On the contrary, Rps1-k was introgressed from the cultivar Kingwa (*G. max*). Previously we reported polymorphisms for 10% of the DNA fragments from cvs. Williams and Kingwa as opposed to only 2% of the DNA fragments from Williams and Elgin. The amount of polymorphisms between Kingwa and Williams is again about three-fold higher at the Rps1-k region than that in the rest of the genome (Kasuga et al., 1997). Thus, we observed a very high level of polymorphisms at the Rps1 region. High rate of recombination in the maize Rp1 locus is considered to result in rapid evolution of new specificities. The implication of reduced recombination rates in disease resistance loci is not yet understood. Higher levels of polymorphisms at the loci like Mla or Rps1 could only result in unequal crossing over and duplication of resistance genes. Poor recombination frequencies in those loci presumably establish the identity of duplicated genes that undergo point mutation and diversified selection for the generation of new race specificities.

Related members of the candidate Rps1-k gene family are organized as clustered loci: We have sequenced BAC clones of the Rps1-k region and observed that LRR sequences discovered in this investigation are the only class of sequences that have similarities to disease resistance genes (Ori et al., 1997). Based on sequencing of 13 individual LRR copies from BAC18, 43 and 99 five distinct members of the LRR gene family were identified from the Rps1-k region. Candidate LRR sequences representing Rps1-k have several related members in the soybean genome. Transcripts of four members were identified from cDNA cloning experiments. Candidate Rps1-k genes are transcribed at a level undetectable by the conventional cDNA cloning approach. Endonucleases BclI, BglII and HindIII resulted in one or two intensely hybridizing bands (FIG. 2). This indicates that most copies were originated from a common ancestor through duplication. For example, at least 30 copies of the LRR-like sequences carry a unique 2.3 kb HindIII fragment (FIGS. 2 and 6). Five copies isolated from the Rps1-k region share very high identity, and in fact they form two classes of identical genes. These results indicate that an active gene duplication mechanism is operative in the Rps1-k region.

We have mapped most of these LRR sequences to six distinct loci in a 3 cM region carrying Rps1-k at one end (FIG. 7D). Occurrence of clusters of paralogous disease resistance gene sequences has appeared to be the rule rather than the exception. Twenty-four paralogous downy mildew resistance gene sequences were identified from about 3.5 megabases of sequences in lettuce (Meyers et al., 1998; Chin et al., 2001). Likewise, in tomato duplication before organization of homologues of Cf-9 into two distinct loci has been suggested (Parniske and Jones, 1999). Multiple paralogous sequences are also clustered in single loci of the same or different chromosomes (Song et al., 1995; Dixon et al., 1996; Anderson et al., 1997). Simple organization of resistance genes is almost an exception (Grant et al., 1995). On the contrary, although it is rare, three distinct NBS-LRR resistance gene homologue families were discovered in the Mla locus (Wei et al., 1999). We used TaqI-digested DNA of recombinants in mapping four additional loci carrying LRR sequences related to candidate Rps1-k genes. It is worth noting that in the Rps1-k region, local duplication is not restricted to these LRR sequences. Earlier we have reported local duplication of molecular markers in the 3 cM region that carries Rps1-k (Kasuga et al., 1997). Here we have shown the duplication of two physically associated molecular markers among progenies of the recombinant R910 (FIG. 3-*a*). It appears that local duplication is a general characteristic of the Rps1-k region.

Unequal crossing over for tandem duplication and creation of new race-specificities: These highly related LRR sequences were perhaps evolved through a regional duplication phenomenon. A possible role of transposable element in resistance gene multiplication has been discussed (Pamiske and Jones, 1999). To date, no active transposable element has been identified in soybean. Furthermore, polymorphic sequences were mapped to a small genomic region. This favors a local duplication mechanism rather than transposition events for their multiplication. Tandem paralogous sequences can be originated through unequal crossing over. Unequal recombination could be either inter- or intra-genic. Intra-genic recombination has been shown to create new race-specificity in flax (Luck et al., 2000). A similar mechanism may be responsible for the creation of new race-specificities in the Rp1 locus of maize (Hulbert et al., 2001). Frequent unequal crossing over tends to homogenize duplicated sequences that have undergone mutation and diversification. This slows down the process of evolution of new race specificities among duplicated genes (Hulbert et al., 2001). Paralogous Dm3 and Pto loci sequences are more diverse than orthologous sequences of two lines or species indicating rareness of unequal crossing over in these two loci (Michelmore and Meyers, 1998). Rps1-k and rps1-k haplotypes are highly diverse, and therefore, any crossing over in this region will most likely be an unequal one. Of the two recombinants studied, R910 carries rps1-k- and Rps1-k-specific alleles for both 18R and TC1 loci that are physically linked (FIG. 3 and data not shown). Allelomorphs of these two loci from both haplotypes recombined in R910 presumably through an unequal crossing over. Most likely the very same mechanism leads to tandem duplication of LRR sequences in the Rps1-k region. Duplicated functional resistance genes, resulted in from such an event, then undergo diversifying selection for the evolution of new race-specificity. In this process the frequency of mutants showing new race-specificities will be much fewer than the number of loss of function mutants. Availability of many duplicated copies ensures redundancy of functions, and provides a means for generating new variation without compromising necessary resistance specificities against the prevalent pathogenic races. Thus, tandem duplication through unequal crossing over between highly diverse haplotypes results in a unique opportunity for the evolution new race-specificities. Reduced recombination rates in the Rps1-k region keep the novel genotypes, generated through unequal crossing over, free from any further rearrangements and, thereby, preserve their identities. We propose that unequal crossing over resulted in tandem duplication of disease resistance gene sequences within the Rps1 region leading to evolution of new *Phytophthora*-resistance specificities.

REFERENCES

Anderson, P. A., Lawrence, G. J., Morrish, B. C., Ayliffe, M. A., Finnegan, E. J., and Ellis, J. G. (1997). Inactivation of the flax rust resistance gene M associated with loss of a repeated unit within the leucine-rich repeat coding region. Plant Cell 9, 641-651.

Arumuganathan, K., and Earle, E. D. (1991). Nuclear DNA content of some important plant species. Plant Mol. Biol. Rep. 9, 208-218.

Bhattacharyya, M. K. (2001). Construction of cDNA libraries. In Essential Molecular Biology: A Practical Approach, T. A. Brown, ed (Oxford University Press), pp. 42-62.

Bhattacharyya, M. K., and Ward, E. W. B. (1986). Expression of gene-specific and age-related resistance and the accumulation of glyceollin in soybean leaves infected with *Phytophthora megasperma* f.sp. glycinea. Physiol. Mol. Plant. Pathol. 29, 105-113.

Bhattacharyya, M. K., Gonzales, R. A., Kraft, M., and Buzzell, R. I. (1997). A copia-like retrotransposon Tgmr closely linked to the Rps1-k allele that confers race-specific resistance of soybean to *Phytophthora sojae*. Plant Mol Biol 34, 255-264.

Chin, D. B., Arroyo-Garcia, R., Ochoa, O. E., Kesseli, R. V., Lavelle, D. O., and Michelmore, R. W. (2001). Recombination and spontaneous mutation at the major cluster of resistance genes in lettuce (*Lactuca sativa*). Genetics 157, 831-849.

Collins, N., Drake, J., Ayliffe, M., Sun, Q., Ellis, J., Hulbert, S., and Pryor, T. (1999). Molecular charactization of the maize Rp1-D rust resistance haplotype and its mutant. Plant Cell 11, 1365-1376.

Cregan, P. B., Jarvik, T., Bush, A. L., Shoemaker, R. C., Lark, K. G., Kahler, A. L., Kaya, N., VanToai, T. T., Lohnes, D. G., Chung, J., and Specht, J. E. (1999). An integrated genetic linkage map of the soybean genome. Crop Sci. 39, 1464-1490.

Deslandes, L., Olivier, J., Theulieres, F., Hirsch, J., Feng, D. X., Bittner-Eddy, P., Beynon, J., and Marco, Y. (2002). Resistance to Ralstonia solanacearum in *Arabidopsis thaliana* is conferred by the recessive RRS1—R gene, a member of a novel family of resistance genes. Proc Natl Acad Sci USA 99, 2404-2409.

Dixon, M. S., Jones, D. A., Keddie, J. S., Thomas, C. M., Harrison, K., and Jones, J. D. (1996). The tomato Cf-2 disease resistance locus comprises two functional genes encoding leucine-rich repeat proteins. Cell 84, 451-459.

Frame, B. R., Shou, H., Chikwamba, R. K., Zhang, Z., Xiang, C., Fonger, T. M., Pegg, S. E., Li, B., Nettleton, D. S., Pei, D., and Wang, K. (2002). *Agrobacterium tumefaciens*-Mediated Transformation of Maize Embryos Using a Standard Binary Vector System. Plant Physiol 129, 13-22.

Ganal, M. W., and Tanksley, S. D. (1996). Recombination around the Tm2a and Mi resistance genes in different crosses of *Lycopersicon peruvianum*. Theor. Appl. Genet. 92, 101-108.

Graham, M. A., Marek, L. F., Lohnes, D., Cregan, P., and Shoemaker, R. C. (2000). Expression and genome organization of resistance gene analogs in soybean. Genome 43, 86-93.

Grant, M. R., Godiard, L., Straube, E., Ashfield, T., Lewald, J., Sattler, A., Innes, R. W., and Dangl, J. L. (1995). Structure of the *Arabidopsis* RPM1 gene enabling dual specificity disease resistance. Science 269, 843-846.

Hulbert, S. H., Webb, C. A., Smith, S. M., and Sun, Q. (2001). Resistance gene complexes: evolution and utilization. Annu. Rev. Phytopathol. 39, 285-312.

Kaloshian, I., Yaghoobi, J., Liharska, T., Hontelez, J., Hanson, D., Hogan, P., Jesse, T., Wijbrandi, J., Simons, G., Vos, P., Zabel, P., and Williamson, V. M. (1998). Genetic and physical localization of the root-knot nematode resistance locus mi in tomato. Mol. Gen. Genet. 257, 376-385.

Kasuga, T., Salimath, S. S., Shi, J., Gijzen, M., Buzzell, R. I., and Bhattacharyya, M. K. (1997). High resolution genetic and physical mapping of molecular markers linked to the *Phytophthora* resistance gene Rps1-k in soybean. Mol. Plant-Microbe Interact. 10, 1035-1044.

Kim, U. J., Birren, B. W., Slepak, T., Mancino, V., Boysen, C., Kang, H. L., Simon, M. I., and Shizuya, H. (1996). Construction and characterization of human bacterial artificial chromosome library. Genomics 34, 213-218.

Konieczny, A., and Ausubel, F. M. (1993). A procedure for mapping *Arabidopsis* mutations using co-dominant ecotype-specific PCR-based markers. Plant J. 4, 403-410.

Luck, J. E., Lawrence, G. J., Dodds, P. N., Shepherd, K. W., and Ellis, J. G. (2000). Regions outside of the leucine-rich repeats of flax rust resistance proteins play a role in specificity determination. Plant Cell 12, 1367-1377.

Manly, K., and Cudmore, R. (1995). Map Manager Version 2.6.5. Web site: http://mcbio.med.buffalo.edu/mapmgr.html.

Marek, L. F., and Shoemaker, R. C. (1997). BAC contig development by fingerprint analysis in soybean. Genome 40, 420-427.

Meyers, B. C., Chin, D. B., Shen, K. A., Sivaramakrishnan, S., Lavelle, D. O., Zhang, Z., and Michelmore, R. W. (1998). The major resistance gene cluster in lettuce is highly duplicated and spans several megabases. Plant Cell 10, 1817-1832.

Michelmore, R. W., and Meyers, B. C. (1998). Clusters of resistance genes in plants evolve by divergent selection and a birth-and-death process. Genome Res. 8, 1113-1130.

Ori, N., Eshed, Y., Paran, I., Presting, G., Aviv, D., Tanksley, S., Zamir, D., and Fluhr, R. (1997). The I2Cfamily from the wilt disease resistance locus I2 belongs to the nucleotide binding, leucine-rich repeat superfamily of plant resistance genes. Plant Cell 9, 521-532.

Parniske, M., and Jones, J. D. (1999). Recombination between diverged clusters of the tomato Cf-9 plant disease resistance gene family. Proc. Natl. Acad. Sci. USA 96, 5850-5855.

Salimath, S. S., and Bhattacharyya, M. K. (1999). Generation of a soybean BAC library, and identification of DNA sequences tightly linked to the Rps1-k disease resistance gene. Theor. Appl. Genet. 98, 712-720.

Sandhu, D., and Gill, K. S. (2002). Gene-containing regions of wheat and the other grass genomes. Plant Physiol 128, 803-811.

Song, W.-Y., Wang, G.-L., Kim, H.-S., Pi, L.-Y., Holsten, T., Gardner, J., Wang, B., Zhai, W.-X., Zhu, L.-H., Fauquet, C., and Ronald, P. (1995). A receptor kinase-like protein encoded by the rice disease resistance gene, Xa21. Science 270, 1804-1806.

Tanksley, S. D., Ganal, M. W., Prince, J. P., de Vicente, M. C., Bonierbale, M. W., Broun, P., Fulton, T. M., Giovannoni, J. J., Grandillo, S., Martin, G. B., and et al. (1992). High density molecular linkage maps of the tomato and potato genomes. Genetics 132, 1141-1160.

van Daelen, R. A. J. J., Gerbens, F., Ruissen, F.v., Aarts, J., Hontelez, J., and Zabel, P. (1993). Long-range physical maps of two loci (Aps-1 and GP79) flanking the root-knot nematode resistance gene (Mi) near the centromere of tomato chromosome 6. Plant mol biol 23, 185-192.

Ward, E. W. B., Stössel, P., and Lazarovits, G. (1981). Similarities between age-related and race-specific resistance of soybean hypocotyls to *Phytophthora megasperma* var. *sojae*. Phytopathology 71, 504-508.

Ward, E. W. B., Lazarovits, G., Unwin, C. H., and Buzzell, R. I. (1979). Hypocotyl reactions and glyceollin in soybeans inoculated with zoospores of *Phytophthora megasperma* var. *sojae*. Phytopathology 69, 951-955.

Wei, F., Gobelman-Werner, K., Morroll, S. M., Kurth, J., Mao, L., Wing, R., Leister, D., Schulze-Lefert, P., and Wise, R. P. (1999). The Mla (powdery mildew) resistance cluster is associated with three NBS-LRR gene families and suppressed recombination within a 240-kb DNA interval on chromosome 5S (1HS) of barley. Genetics 153, 1929-1948.

White, J. L., and Kaper, J. M. (1989). A simple method for detection of viral satellite RNAs in small plant tissue samples. J. Virol. Methods 23, 83-94.

Example 2

Materials and Methods

Subcloning and sequencing of BAC clones: Three overlapping BAC clones, BAC18, BAC43 and BAC99 carrying the Rps1-k locus were sequenced using a shot-gun approach. To minimize *E. coli* DNA contamination, DNA of the three BAC clones was prepared with Qiagen Large Construct Kit (Qiagen, Valencia, Calif.). Two shotgun libraries for each BAC clones were constructed. One library was made using Topo shotgun subcloning kit (Invitrogen, Carlsbad, Calif.). Briefly, individual BAC DNA was nebulized under 5 psi for 10 seconds. Fragments of 5 to 10 kb were blunt-ended, dephosphorylated and ligated to vector pCR4BluntTOPO. For the other library, DNA of each BAC was partially digested with Sau3AI, DNA fragments around 20 kb were purified and then ligated into the dephosphorylated BamHI restriction site of the binary vector pTF101.1 (refer these clones to pTF101.1 clones). Colonies were picked randomly and stored in 96-well microtiter plates. Plasmid DNA was prepared applying Montage plasmid Miniprep Kit (Millipore, Bedford, Mass.). DNA sequencing was run on ABI PRISM 3700 Analyzer by the DNA sequencing facility at Iowa State University.

The sequence data were assembled using Phred/Phrap software on a PC using Linux operating system. The resulted contigs of each BAC were ordered into scaffold manually using the read pairs. Primer walking was applied to fill the remaining gaps. The assembled sequences were searched against GenBank using BlastX algorithm (www.ncbi.nlm.gov). Four NBS-LRR-type genes were identified. A series of primers for both strands were designed in every 200-300 bp from the consensus sequence of the four NBS-LRR sequences.

Sequencing and sequence Analysis of NBS-LRR clones: The pTF101.1 clones used for sequencing were hybridized to NBS or/and LRR probes. The positive clones were then classified into seven putative groups by DNA finger-printing. At least one clone from each group and a total of 13 clones were sequenced using primers designed based on the consensus NBS-LRR sequence. Each nucleotide was sequenced at least three times. The sequence reads of each clone were assembled using Vector NTI Suite 6 (v.6 for PC, InforMax Inc.) program. The gene structure was predicted with Genscan (www/gemes/,ot/ediGENSCAN.html).

Complementation analyses: Genomic clones 99-6A (Rps1-k-2), 43-10 (Rps1-k-3) and 43-JP1 (Rps1-k-S) carrying DNA fragments from BAC99 and BAC43 in pTF101.1 vector, were electroporated into the *Agrobacterium tumefaciens* strain EHA101 (Zhang et al., 1999). The *Agrobacterium*-mediated transformation of cotyledonary explants of the cultivar Williams 79 (Rps1-c) for these plasmids was performed by Plant Transformation Facility at Iowa State University. R1 progenies of independent transformants derived from 99-6A, 43-10 and 43-JP1 were tested for Rps1-k-specific resistance. Detached soybean leaves from two-week-old soybean plants or etiolated hypocotyls of seven-day old seedlings were inoculated with zoospore suspensions of the *P. sojae* race 4 (Bhattacharyya and Ward, 1986). In leaves symptoms were evaluated 48 and 72 hours following inoculation. The average spread of lesions per day was then determined. Inoculated hypocotyls were evaluated 24 h following inoculation for resistant (hypersensitive cell death) and susceptible (lack of hypersensitive cell death) responses.

Results

Identification and characterization of five highly identical candidate genes from the Rps1-k region: Rps1-k has been mapped to a region that is physically spanned by three overlapping soybean bacterial artificial chromosomes (BACs) clones: BAC18, BAC43, and BAC99 isolated from a library prepared from the cultivar Williams 82 (Rps1-k) (Bhattacharyya, unpublished data). Five highly identical C-C NBS-LRR-type genes were identified through sequencing of these three BACs and subsequent sequencing of the NBS-LRR clones in the binary vector pTF101.1. Except for a truncated serinine/threonine kinase sequence, no other disease resistance gene homologs were revealed from sequence analysis of the three BACs. Therefore, we designated the five C-C NBS-LRR-type genes as Rps1-k-i to Rps1-k-5. Open reading frames (ORFs) of members of this Rps1-k gene family share 93% to 100% nucleotide and 89.9% to 100% amino acid sequence identity (Table 1); and all the ORFs carry no introns. One hundred and five variable positions, aside from three deletions of one, two, and 21 amino acids, were identified in these ORFs. Thirty-four variable positions were found at the N-terminus of the protein, which has a C-C motif and a NBS domain, and 71 at the C-terminus of the protein that carries a LRR domain. There are only two alternative residues in all mutations; these are called informative polymorphic sites (IPSs) because they occur in more than one gene (FIG. 8). These two residues in each position distinguish the two classes of genes. There are three deletions in the 5'-end region, and 6 and 84 IPSs at the 5'- and 3'-end regions, respectively (FIG. 8). Nucleotide sequences of members of the Rps1-k gene family are depicted in the FIG. 9. Three genes, Rps1-k-1, -3, and -5, have identical ORFs and represent one class, whereas identical genes Rps1-k-2 and Rps1-k-4 represent the other. Identical sequences among genes isolated from an approximately 280 kb contiguous DNA fragment of the Rps1-k region made it difficult to identify all members of the gene family. We conclude that there are at least five genes at the Rps1-k locus.

FIG. 8. Alignment of informative polymorphic sites among members of the Rps1-k gene family. (A) IPSs and deletions of 5'-end regions. (B) EPS and deletions among ORFs. (C) IPSs and deletions of 3'-end regions. The Sequence Output for DOS, Version 2.0, was used for this analysis (B. G. Spratt, University of Sussex, Brighton, UK).

TABLE 1

Comparison of open reading frame sequences among members of the Rps1-k gene family

| | Rps1-k-1 | Rps1-k-2 | Rps1-k-3 | Rps1-k-4 | Rps1-k-5 |
|---|---|---|---|---|---|
| Rps1-k-1 | | [1]93.0 | 100.0 | 93.0 | 100.0 |
| Rps1-k-2 | [2]89.9 | | 93.0 | 100.0 | 93.0 |
| Rps1-k-3 | 100.0 | 89.9 | | 93.0 | 100.0 |
| Rps1-k-4 | 89.9 | 100.0 | 89.9 | | 93.0 |
| Rps1-k-5 | 100.0 | 89.9 | 100.0 | 89.9 | |

[1]Upper diagonal (blue): nucleotide sequence comparison.
[2]Lower diagonal (red): amino acid sequence comparison.

FIG. 9. The Rps1-k gene family comprising two classes of identical genes. In developing this figure, informative polymorphic sites (IPSs) were used to trace the lineages of individual genes. Red and black colors show the lineages of members of the gene family. Rps1-k-1 and -5 are identical genes that were cloned from nonoverlapping BAC18 and BAC99. Rps1-k-3 is distinguished from Rps1-k-1 and -5 by a recombination breakpoint between nts 302 and 478 from the stop codon. Rps1-k-2 and -4 are identical except for a single nt deletion at position 1900 from the stop codon. ■, the conserved nucleotide binding site; *, deletion of an nt; , deletion of 63 nts; □, two introns of 142 and 152 nts, respectively.

Six structural domains were identified from the predicted proteins (FIG. 10). A myristylation site can be found in domain A. The coiled-coil motif is located in domain B. The putative NBS domain consisting of the P loop as well as kinase-2 and kinase-3a motifs is present in domain C (Traut, 1994). In this region, all 11 Pan-defined motifs for CC-NBS-LRR R proteins were observed (Pan et al., 2000). Between domain C and E is a short region designated as domain D. Domain E consists of 27 imperfect LRRs, one of which was deleted from Rps1-k-1, -3, and -5 (FIGS. 8 and 9). The deduced amino acid sequences of Rps1-k family show the highest identity to I2C-2.

FIG. 10. Amino acid sequence comparison between Rps1-k-2 and Rps1-k-3. The predicted amino acid sequence of Rps1-k-2 is shown under domains A to F, indicating differences between the two protein sequences. The myristylation site in domain A is underlined. The coiled-coil domain is in domain B. The prediction was performed by COILS (Lupas, 1997). The conserved P loop as well as kinase-2 and kinase-3a sequences in NBS are underlined. The LRR alignment is shown in domain E. The consensus sequence in LRRs is indicated by xxLxLxx (SEQ ID NO:140) in the line above the alignment of LRRs (L can be replaced by V, F or M). The leucine-zipper-like motif is shown in bold. Domain F is the C-terminus. The red-highlighted residues are the sites that vary between Rps1-k-2 and Rps1-k-3. One LRR repeat of 21 amino acids was deleted from Rps1-k-3 and is shown by green color in Rps1-k-2.

Diversifying selection and frequency of mutation in Rps1-k genes: Solvent-exposed residues within the consensus sequence xxLxLxx (SEQ ID NO:140) of LRRs are highly divergent (Jones and Whittingham, 1996) (FIG. 10). To determine the selection pressure exerted on the Rps1-k gene family, ratios of synonymous (Ks) and nonsynonymous (Ka) substitution were calculated for different regions of the two classes (Table 2). The highest Ka/Ks ratio observed was for the xxLxLxx sequence of the LRRs indicating the pressure of diversifying selection on the predicted solvent-exposed residues necessary for the creation of new race specificities (Parniske et al., 1997; Meyers et al., 1998). Comparisons of frequencies of mutation in C-C, NBS, and LRR domains with those in 5'- and 3'-end regions revealed that mutation frequencies were almost the same, about 0.02 per site among all regions except the LRR domains, where a tenfold higher frequency of nonsynonymous substitution mutation was observed between members of two Rps1-k gene classes (Table 3). This indicates that LRR domains are prone to the spontaneous mutation required for generating new race-specific resistance.

Complementation analysis: To establish the functional identity of members of the Rps1-k gene family, three genomic clones 99-6A (Rps1-k-2), 43-10 (Rps1-k -3) and 43-JP1 (Rps1-k -5) were introduced into the soybean cv. Williams 79 (Rps1-c) through the *Agrobacterium*-mediated transformation procedures (Zhang et al., 1999). Independent $R_0$s as well as $R_1$ and $R_2$ progeny populations confirmed that all three genes encode Rps1-k-specific resistance in soybean leaves ($R_1$) and etiolated hypocotyls ($R_2$) against *P. sojae* race 4 (FIG. 11 and Table 4). $R_1$ progenies of all three independent transformants carrying Rps1-k-3 and one transformant carrying Rps1-k-2 or Rps1-k-5 showed a segregating 3:1 ratio of resistance to susceptibility. Segregation of resistance and susceptibility was observed among $R_2$ progenies.

TABLE 2

Rates of non-synonymous (Ka) and synonymous (Ks)[1] substitutions in the evolution of the Rps1-k gene family

| Region/Domain | Ka/Ks |
|---|---|
| ORF | 0.625 |
| Coiled-coil domain | 0.29 |
| NBS domain | 0.33 |
| XxLxLxx[2] (SEQ ID NO:140) | 2.33 |
| C-terminus (LRR-xxLxLxx) (SEQ ID NO:247) | 1 |

[1]The ratio of non-synonymous (Ka) and synonymous (Ks) substitution in variable sites was calculated by comparing the ORF sequences of Rps1-k-2 and Rps1-k-3. The SNA program (Synonymous/Non-synonymous Analysis Program: (www.hiv-web.lanl.gov/content/hiv-db/SNAP/WEBSNAP/SNAP.html) was used in calculating the substitution values.
[2]Conserved hydrophobic sites (L, V, F, and M) were omitted from the calculation of the Ka/Ks ratio in the xxLxLxx (SEQ ID NO:140) region.

TABLE 3

A tenfold increase in nonsynonymous mutation frequency among LRRs

| Region | 5'- | ORF | | | | | | 3'- |
|---|---|---|---|---|---|---|---|---|
| | | C-C | | NBS | | LRR (only repeats) | | |
| Mutation | end | Synonymous | Nonsynonymous | Synonymous | Nonsynonymous | Synonymous | Nonsynonymous | end |
| Substitutions | 6 | 6 | 7 | 18 | 23 | 6 | 54 | 60 |
| Total Length | 298 | 336 | | 1056 | | 300[1] | | 2095 |
| Mutation Frequency | 0.02 | 0.017 | 0.021 | 0.017 | 0.022 | 0.02 | 0.18 | 0.028 |

[1]It includes ony the solvent exposed residues.

TABLE 4

Segregation of transgenes among $R_1$ progeny populations

| $R_1$ | R[1] | S | $X^2_{(3:1)}$ | P ($X^2_{(3:1)}$) |
|---|---|---|---|---|
| [2]T-Rps1-k-2-1 | 11 | 6 | 0.961 | 0.327 |
| T-Rps1-k-2-2 | 2 | 16 | 39.185 | <0.0001 |
| T-Rps1-k-2-3 | 2 | 15 | 36.255 | <0.0001 |
| T-Rps1-k-2-4 | 0 | 16 | 48.000 | <0.0001 |
| T-Rps1-k-2-5 | 5 | 10 | 13.899 | 0.0002 |
| [2]T-Rps1-k-3-1 | 13 | 5 | 0.074 | 0.785 |
| [2]T-Rps1-k-3-2 | 11 | 7 | 1.852 | 0.174 |
| [2]T-Rps1-k-3-3 | 13 | 5 | 0.074 | 0.785 |
| [2]T-Rps1-k-5-1 | 10 | 2 | 0.444 | 0.505 |

[1]R, resistant phenotype; S, susceptible phenotype.
[2]Showed a 3:1::R:S segregation ratio.

Co-segregation of a transgene copy with the expression of *Phytophthora* resistance: Transgenic plants showed to carry multiple T-DNA inserts. We investigated if the complemented resistance phenotype is encoded by a transgene. Progenies from individual $R_1$ plants carrying the transgene Rps1-k-2 were investigated for expression of *P. sojae* race 4-specific resistance and segregation of transgene copies. The results of an experiment are presented in FIG. 12. The expression of *Phytophthora* resistance among the $R_2$ progenies correlated positively with one of the transgene copies. This confirmed that Rps1-k-2 encodes *Phytophthora* resistance. However, we have not been able to find any correlation between the integration of transgenes Rps1-k-3 and Rps1-k-5 with the complemented resistance phenotype.

Soybean genome comprised of about 38 copies of the Rps1-k-like sequences (Bhattacharyya, unpublished). Most likely the transcriptional gene silencing phenomenon may have suppressed the expression of copies of the Rps1-k transgenes in transgenic plants (Vaucheret and Fagard, 2001). We applied an RT-PCR approach to determine the association between observed phenotypes and the transgene expression. Two primers representing sequences that flank these two adjacent introns were applied to carry out the RT-PCR experiment and results are presented in the FIG. 12. A clear-cut association between the complemented resistant phenotype and amplification of a cDNA fragment from the Rps1-k-S transgene was observed among progenies of the T-Rps1-k-5-1 (Table 4).

FIG. 11. The complementation analysis of three genes isolated from the Rps1-k locus. (A) A transgenic $R_0$ leaf shows hypersensitive cell death and typical resistance response. (B) Symptom development among R1 progeny populations. Lesion size was recorded two and three days following inoculation and lesion spread was determined in millimeters per day.

FIG. 12. Co-segregation of an Rps1-k-2 transgene copy with the expression of resistance against *P. sojae* race 4. Etiolated hypocotyls of individual $R_2$ plants from independent $R_1$ progenies were inoculated with the zoospore suspensions and infected seedlings were evaluated 24 h following inoculation (Ward et al. 1979). Phytphthora resistance was co-segregated with a transgene, which is shown by an arrow.

Discussion

Five Rps1-k genes were identified through map-based cloning. They were grouped into two classes. These genes are transcribed to a level undetectable by conventional cDNA cloning experiments (Bhattacharyya, unpublished). Function of one gene was established by complementation and Southern blot analyses. Sequence analyses indicated they all encode C-C NBS-LRR type resistance genes. Complete sequence identity among individual members of each class indicated that they were evolved through a local gene duplication of two progenitor genes (FIG. 9). At least two rounds of duplication resulted in new members of the Rps-k gene family. A single nucleotide-deletion mutation occurred following duplication; it was detected among 6149 residues of Rps1-k-2 (FIG. 9). Concerted evolution has been shown to have a major role in evolution of tandemly arranged repeat sequence families, such as snRNAs in humans (Liao et al., 1997) and rDNA in yeast (Gangloff et al., 1996). However, it is unlikely that the high identity observed among members of the Rps1-k gene family resulted from this concerted evolution. Homogenization, a requirement for concerted selection, acts against the diversification and generation of novel race-specificities. Parniske et al. (Parniske et al., 1997) proposed that sequence homogenization could be prevented by the suppression of unequal recombination between two polymorphic intergenic sequences. Rps1-k is located in a highly recombination-suppressed region; therefore, homogenization is unlikely the reason for 100% identity among members of individual Rps1-k gene classes (Bhattacharyya unpublished). Gene conversion, a major sequence homogenization mechanism for concerted selection, is not a likely cause for 100% identity between members of individual Rps1-k gene classes either. Gene conversion tracts are mostly limited to ORFs and are relatively small (Hilliker et al., 1994; Semple and Wolfe, 1999; Drouin, 2002).

To date, no two identical R genes have been identified from the same haplotype. In flax, L3 and L10 carry identical ORFs, while L4 differed from these two by a single nucleotide (Ellis et al., 1999). However, L3, L4, and L10 are from three independent haplotypes. Two nearly identical resistance genes were cloned from the tomato Cf-2 locus. These two genes differ by three nucleotide or amino acids (Dixon et al., 1996). Duplicated functional genes in an R gene cluster as in Rps-k provide advantages for generation of new resistance genes. One member of duplicated genes preserves the original race specificity for the existing pathogenic races, while others can advance the evolution for new race specificities.

Two progenitor genes differing at 58 synonymous substitutions in the ORF of 3756 nts and giving rise to two Rps1-k gene classes must have started to diverge about 10 million years ago. The evolution of members of the Rps1-k gene family from these two progenitor genes most likely occurred through unequal crossing over following natural cross-pollination. The alternative and lesser-likely scenario would be the evolution of both progenitor genes from the same haplotype followed by relatively recent evolution of individual members of Rps1-k gene classes through a regional duplication mechanism.

In self-pollinated species lettuce, the loss-of-function mutants are generated at a rate of $6\times10^{-4}$ per generation, mostly from large deletions (Chin et al., 2001). In the tomato, however, no spontaneous loss-of-function mutants were identified from selfed-progenies (Parniske et al., 1997). Self-pollinated species are less likely to produce genetic variation through unequal crossing over, which usually occurs between two diverse haplotypes following open pollination in cross-pollinated species. This raises a question about the mechanism(s) of duplication for evolution of new variations in self-pollinated species. Unequal crossing over between two identical Rps1-k haplotypes of a soybean line can occur through the mispairing of repeat sequences. This mechanism allows the duplication of DNA sequences of two identical haplotypes in a self-pollinated plant species leading to the generation of new genetic variations for those traits that require rapid evolution. Identical *Phytophthora* resistance genes at the Rps1-k locus support the existence of such a mechanism in soybean.

REFERENCES

Anderson, T. R., and Buzzell, R. I. (1992). Inheritance and linkage of the Rps 7 gene for resistance to *Phytophthora* rot of soybean. Plant Dis. 76, 958-959.

Bhattacharyya, M. K., and Ward, E. W. B. (1986). Expression of gene-specific and age-related resistance and the accumulation of glyceollin in soybean leaves infected with *Phytophthora* megasperma f.sp. glycinea . Physiol. Mol. Plant. Pathol. 29, 105-113.

Bhattacharyya, M. K., Narayanan, N. N., Salimath, S. S., Santra, D. K., Ellison, L., Kasuga, T., Liu, Y., Espinosa, B., Marek, L., Shoemaker, R. C., Gijzen, M., Buzzell, R. I. (2003). Positional Cloning of a Highly Repetitive LRR-type Disease Resistance Gene Sequence that Co-Segregates with the *Phytophthora* Resistance Gene Rps1-k in Soybean. Genetics.

Brueggeman, R., Rostoks, N., Kudrna, D., Kilian, A., Han, F., Chen, J., Druka, A., Steffenson, B., and Kleinhofs, A. (2002). The barley stem rust-resistance gene Rpg1 is a novel disease-resistance gene with homology to receptor kinases. Proc Natl Acad Sci USA 99, 9328-9333.

Burnham, K. D., Dorrance, A. E., Francis, D. M., Fioritto, R. J., Martin, S. K. St. (2003). Rps8, A New Locus in Soybean for Resistance to *Phytophthora sojae*. Crop Sci 43, 101-105.

Chin, D. B., Arroyo-Garcia, R., Ochoa, O. E., Kesseli, R. V., Lavelle, D. O., and Michelmore, R. W. (2001). Recombination and spontaneous mutation at the major cluster of resistance genes in lettuce (*Lactuca sativa*). Genetics 157, 831-849. Deslandes L, Olivier J, Theulieres F, Hirsch J, Feng D X, Bittner-Eddy P, Beynon J, Marco Y. (2002). Resistance to Ralstonia solanacearum in *Arabidopsis thaliana* is conferred by the recessive RRS1-R gene, a member of a novel family of resistance genes. Proc Natl Acad Sci USA 99, 2404-2409

Dixon, M. S., Jones, D. A., Keddie, J. S., Thomas, C. M., Harrison, K., and Jones, J. D. (1996). The tomato Cf-2 disease resistance locus comprises two functional genes encoding leucine-rich repeat proteins. Cell 84, 451-459.

Drouin, G. (2002). Characterization of the gene conversions between the multigene family members of the yeast genome. J Mol Evol 55, 14-23.

Ellis, J. G., Lawrence, G. J., Luck, J. E., and Dodds, P. N. (1999). Identification of regions in alleles of the flax rust resistance gene L that determine differences in gene-for-gene specificity. Plant Cell 11, 495-506.

Frame, B. R., Shou, H., Chikwamba, R. K., Zhang, Z., Xiang, C., Fonger, T. M., Pegg, S. E., Li, B., Nettleton, D. S., Pei, D., and Wang, K. (2002). *Agrobacterium tumefaciens*-Mediated Transformation of Maize Embryos Using a Standard Binary Vector System. Plant Physiol 129, 13-22.

Gangloff, S., Zou, H., and Rothstein, R. (1996). Gene conversion plays the major role in controlling the stability of large tandem repeats in yeast. Embo J 15, 1715-1725.

Hammond-Kosack, K. E., Jones, J. D. G. (1997). Plant disease resistance genes. Annu. Rev. Plant Physiol. Plant Mol. Biol. 48, 575-607.

Hilliker, A. J., Harauz, G., Reaume, A. G., Gray, M., Clark, S. H., and Chovnick, A. (1994). Meiotic gene conversion tract length distribution within the rosy locus of *Drosophila melanogaster*. Genetics 137, 1019-1026.

Hulbert, S. H., Webb, C. A., Smith, S. M., and Sun, Q. (2001). Resistance gene complexes: evolution and utilization. Annu Rev Phytopathol 39, 285-312.

Jones, K. T., and Whittingham, D. G. (1996). A comparison of sperm- and IP3-induced Ca2+ release in activated and aging mouse oocytes . Dev. Biol. 178, 229-237.

Kawchuk, L. M., Hachey, J., Lynch, D. R., Kulcsar, F., van Rooijen, G., Waterer, D. R., Robertson, A., Kokko, E., Byers, R., Howard, R. J., Fischer, R., and Prufer, D. (2001). Tomato Ve disease resistance genes encode cell surface-like receptors. Proc Natl Acad Sci USA 98, 6511-6515.

Kobe, B., and Kajava, A. V. (2001). The leucine-rich repeat as a protein recognition motif. Curr Opin Struct Biol 11, 725-732.

Liao, D., Pavelitz, T., Kidd, J. R., Kidd, K. K., and Weiner, A. M. (1997). Concerted evolution of the tandemly repeated genes encoding human U2 snRNA (the RNU2 locus) involves rapid intrachromosomal homogenization and rare interchromosomal gene conversion. Embo J 16, 588-598.

Lupas, A. (1997). Predicting coiled-coil regions in proteins. Curr Opin Struct Biol 7, 388-393.

Martin, G. B., Brommonschenkel, S. H., Chunqongse, J., Frary, A., Ganal, M. W., Spivey, R., Wu, T., Earle, E. D., and Tanksley, S. D. (1993). Map-based cloning of a protein kinase gene conferring disease resistance in tomato. Science 262, 1432-1436.

Meyers, B. C., Shen, K. A., Rohani, P., Gaut, B. S., and Michelmore, R. W. (1998). Receptor-like genes in the major resistance locus of lettuce are subject to divergent selection. Plant Cell 10, 1833-1846.

Michelmore, R. W., and Meyers, B. C. (1998). Clusters of resistance genes in plants evolve by divergent selection and a birth-and-death process. Genome Res. 8, 1113-1130.

Pan, Q., Wendel, J., and Fluhr, R. (2000). Divergent evolution of plant NBS-LRR resistance gene homologues in dicot and cereal genomes. J Mol Evol 50, 203-213.

Parniske, M., Hammond-Kosack, K. E., Golstein, C., Thomas, C. M., Jones, D. A., Harrison, K., Wulff, B. B., and Jones, J. D. (1997). Novel disease resistance specificities result from sequence exchange between tandemly repeated genes at the Cf-4/9 locus of tomato. Cell 91, 821-832.

Polzin, K. M., Lorenzen, L. L., Olson, T. C., and Shoemaker, R. C. (1994). An unusual polymorphic locus useful for tagging Rps 1 resistance alleles in soybean. Theor. Appl. Genet. 89, 226-232.

Richly, E., Kurth, J., and Leister, D. (2002). Mode of amplification and reorganization of resistance genes during recent *Arabidopsis thaliana* evolution. Mol Biol Evol 19, 76-84.

Schenk, P. M., Kazan, K., Wilson, I., Anderson, J. P., Richmond, T., Somerville, S. C., and Manners, J. M. (2000). Coordinated plant defense responses in *Arabidopsis* revealed by microarray analysis. Proc Natl Acad Sci USA 97, 11655-11660.

Schmitthenner, A. F. (1989). *Phytophthora* rot. In Compendium of soybean diseases, J. B. Sinclair and P. A. Backman, eds (St. Paul, Minn.: APS Press), pp. 35-38.

Semple, C., and Wolfe, K. H. (1999). Gene duplication and gene conversion in the *Caenorhabditis elegans* genome. J Mol Evol 48, 555-564.

Traut, T. W. (1994). The functions and consensus motifs of nine types of peptide segments that form different types of nucleotide-binding sites. Eur J Biochem 222, 9-19.

Vaucheret, H., and Fagard, M. (2001). Transcriptional gene silencing in plants: targets, inducers and regulators. Trends Genet 17, 29-35.

Whitham, S., Dinesh-Kumar, S. P., Choi, D., Hehl, R., Corr, C., and Baker, B. (1994). The product of the tobacco mosaic virus resistance gene N: Similarity to toll and the interleukin-1 receptor. Cell 78, 1101-1115.

Wrather, J. A., Anderson, T. R., Arsyad, D. M., Gai, J., Ploper, L. D., Porta-Puglia, A., Ram, H. H., and Yorinori, J. T. (1997). Soybean disease loss estimates for the top 10 soybean producing countries in 1994. Plant Dis. 81, 107-110.

Zhang Z., Xing A, Staswick P., Clemente T. (1999). The use of glufosinate as a selective agent in *Agrobacterium*-mediated transformation of soybean. Plant Cell Tissue Organ Cult. 56, 37-46.

Example 3

Recognition in Disease resistance: Several plant disease resistance genes that follow the classical gene-for-gene hypothesis (Flor, 1955) have been cloned. These genes can be classified into four major groups based on the structures of their protein products: (i) proteins with kinase activity, e.g., Pto and Rpg1 (Martin et al., 1993; Brueggeman et al., 2002); (ii) proteins with nucleotide binding sites (NBS) and leucine rich repeat regions (LRR), e.g., RPS2, N, L6, RPM1, Prf, M, 12, and RPP5 (Anderson et al., 1997; Bent et al., 1994; Grant et al., 1995; Lawrence et al., 1995; Mindrinos et al., 1994; Ori et al., 1997; Parker et al., 1997; Salmeron et al., 1996; Whitham et al., 1994); (iii) proteins with leucine-rich repeat regions and a transmembrane domain, e.g., Cf2, Cf4, and Cf9 (Dixon et al., 1996; Jones et al., 1994; Thomas et al., 1997) and (iv) proteins with leucine-rich repeat regions, a transmembrane, and serine/threonine kinase domains, e.g., Xa21 (Song et al., 1995). The group carrying genes with NBS and LRR motifs can be sub-divided into two subgroups: (a) TIR NBS-LRR genes that carry an N-terminal TIR domain with homologies to Toll receptor of *Drosophila* and interleukin-1R receptor of mammals, and (b) C-C TIR NBS-LRR genes that carry coiled-coil domain at the N-terminus (Meyers et al., 1999). Most of the disease resistance genes cloned recently belongs to the C-C NBS-LRR group, which includes genes that confer resistance to viruses, bacteria, fungi, oomycetes, nematodes, and aphids. TIR NBS-LRR-type genes are most likely absent in the Poaceae (Meyers et al., 1999; Pan et al., 2000).

Cloning of resistance genes and their corresponding avirulence genes allowed us to test the Flor's gene-for-gene hypothesis (Flor, 1955). Interactions between products of resistance genes and those of corresponding avirulence genes do occur in vivo (Jia et al., 2000; Kim et al. 2002; Leister et al., 1996a; Scofield et al., 1996; Tang et al., 1996). Characterization of several resistance genes for allelic variations indicated that the LRR domain is the most-variable part of resistance genes, and the predicted solvent-exposed residues of the LRR region are subjected to diversifying selection. This implies that this diversified region of LRR is most likely involved in specific binding of pathogen-derived ligand (Ellis et al., 1999; Meyers et al., 1998; Pamiske et al., 1997). The in vivo interaction between AvrPita from *Magnaporthe grisea* and LRR domain of Pi-ta from rice supports this conclusion (Jia et al., 2000). Non-LRR regions could also be important in determining race-specificity. For example, evidence supporting the diversifying selection for TIR domains of L alleles in flax has been reported (Luck et al., 2000). Contrary to the possible role of LRR domain in ligandbinding, genetic data showed that LRR domain may have a role in signal transduction (Warren et al., 1998).

Signal Transduction in Disease Resistance: Genetic as well as molecular genetic approaches have been applied to dissect the signal pathway involved in the expression of gene-specific resistance. Genetic screening of mutagenized populations has had limited success in identifying mutants for the signal transduction components. This could be due to the presence of multiple or redundant components in this pathway. Alternatively, such components are essential for viability. Extensive mutantscreening in several laboratories identified a few signal transduction mutants. They are: i) rar1 and rar2 of barley (Jorgensen 1988) rcr1, rcr2, rcr3, and prf in tomato (Dixon et al., 2000; Hammond-Kosack et al., 1994; Salmeron et al., 1994); ndr1, eds1, pbs1, pbs2, and pbs3 in *Arabidopsis* (Century et al., 1995; Parker et al., 1996; Warren et al., 1999). rar mutations in barley affect the expression of several powdery mildew-resistance genes (Freialdenhoven et al., 1994; Jorgensen 1996). Rar1 has been cloned and shown to function upstream of $H_2O_2$ accumulation in infected cells. Silencing of the Rar1 homologue in *Caenorhabditis elegans* resulted in both reduced fecundity and increased embryo mortality, suggesting essential function of the Rar1 homologue in nematodes. It has been proposed that Rar1 plays an essential cellular function. rar1 and rar2 are most unlikely null mutants. Possibly only the subfunction of Rar1 required for disease resistance and cell death is mutated in rar1 (Shirasu et al., 1999). *Arabidopsis* rar1 mutants, however, indicate that the *Arabidopsis* ortholog of barley Rar1 does not play a fundamental role in plant development (Muskett et al., 2002). Rcr1 and Rcr2 are shown to require Cf9 and Rcr3 for Cf2-specific resistance against *Cladosporium fulvum* (Dixon et al., 2000; Hammond-Kosack et al., 1994). Identification of four independent rcr3 mutant alleles indicated the saturation in mutant screening (Dixon et al., 2000). The Prf gene has been cloned and is a member of the C-C NBS-LRR class of resistance genes. It is required for the function of Pto and Fen. The Fen gene confers sensitivity to the insecticide fenthion (Salmeron et al., 1994; 1996). The ndr1 mutant of *Arabidopsis* shows loss of resistance against bacterial pathogens *Pseudomonas* conferred by the C-C NBS-LRR resistance genes such as RPS2, RPM1 and RPS5, while eds1 mutants show loss of resistance against the oomycete pathogen *Peronospora parasitica* conferred by the TIR NBS-LRR resistance genes such as RPP2/4/5121 genes (Aarts et al., 1998; Century et al., 1995). This suggests independent down-stream signal pathways for two classes of NBS-LRR genes and also the importance of N-terminal regions of NBS-LRR genes in signaling. Both NDR1 and EDS1 were cloned. NDR1 is most likely a membrane-associated protein with unknown function, while EDS1 shows a homology to eukaryotic lipases (Century et al., 1997; Falk et al., 1999). pbs1, pbs2, and pbs3 are *Arabidopsis* mutants that show loss of RPS5-specific resistance against *Pseudomonas syringae*. The pbs1 mutant affects only RPS5-specific resistance. On the other hand, pbs2 affects the expression of resistance conferred by RPS5 and RPM1, while pbs3 partially suppresses RPS512/4, RPM1 and RPP (Warren et al., 1999). PBS1 encodes a putative serine-threonine kinase (Swiderski and Innes 2001).

A yeast two-hybrid system has successfully been applied in isolating signal transducing pathway genes for defense gene expression regulated by tomato Pto (Sessa and Martin 2000; Bogdanove and Martin, 2000). A novel protein At-RSH1 showing a high identity to *Escherichia coli* RelA and SpoT proteins for the stringent response, analogous to the stress-induced defense system in plants, has been shown to interact with the NBS-ARC domain of the TIR NBS-LRR-type resistance gene RPP5 in a yeast two-hybrid system (van der Biezen et al., 2000).

In soybean, the Rps1-k-specific resistance against *P. sojae* race 4 and 7, but not against race 1, is significantly compromised in the ethylene mutant etr1 indicating more than one *Phytophthora* resistance gene in the Rps1-k locus, one of which requires a member of the ethylene-signal pathway for expression of *Phytophthora* resistance (Hoffman et al., 1999).

Soybean-*Phytophthora sojae* interaction: Soybean [*Glycine max* L. (Merrill)] is a major oil seed crop and is grown throughout much of the world. The United States alone produces over half of the world output. Soybean seed typically contains 40% protein and 20% oil. It is used primarily for livestock feed and industrial purposes, in addition to human consumption. In North America, soybean suffers yield loss from the root and stem rot disease caused by *P. sojae*. The annual yield loss of soybean from this disease in the United States was valued at about 120 million dollars (Wrather et al., 1997). Monogenic resistance encoded by Rps genes has been providing the soybean crop a reasonable protection against this pathogen for the last four decades. There are several physiological races of this fungal pathogen. The number of races is increasing rapidly. Schmitthenner and his co-workers (1994) concluded that *P. sojae* is a highly variable pathogen that exists in the soil as a wide variety of virulence phenotypes to which most Rps genes are ineffective. They also concluded that unless new Rps genes are identified or existing Rps genes are pyramided in single cultivars, resistance available in the present day cultivars might not be effective in controlling the disease in future.

At present, there are 14 Rps genes that confer race-specific resistance in soybean to different physiological races of *P. sojae* (Anderson and Buzzell, 1992; Polzin et al., 1994; Schmitthenner, 1989; Burnham et al. 2003). The genetics of resistance conferred by Rps genes is well established. Genetics of most of the avirulence genes (Avr) from *P. sojae* have also been reported (Tyler et al., 1995; Whisson et al., 1994; 1995). The interactions between 14 Rps genes with the corresponding Avr genes follow the 'gene-for-gene' hypothesis.

The soybean-*P. sojae* interaction is probably one of the most extensively studied host-pathogen interactions (Graham, 1995; Keen and Yoshikawa, 1990; Paxton, 1995; Ward, 1990). Inoculation of etiolated hypocotyls or roots with zoospore suspensions of *P. sojae* revealed that 3 to 4 h following inoculation host cells associated with the penetrated hyphae remain viable and healthy in the compatible interaction, but not in the incompatible interaction (Enkerli et al., 1997; Ward et al., 1989). The major differences between the two interactions were related to timing of the host responses. The phytoalexin glyceollin accumulates to a significantly high level 8 h after inoculation in the incompatible interaction, but only after 12 h in the compatible interaction (Bhattacharyya and Ward, 1986a). The rapid induction of defense compounds such as glyceollin resulted from the transcriptional activation of genes of the phenylpropanoid pathway. Some of the key enzymes and genes of this pathway are activated within 3 h following inoculation in the resistant response (Bhattacharyya and Ward, 1988; Ebel and Grisebach, 1988; Esnault et al., 1987). Recently we have cloned the Rps1-k gene family and showed that there are at least two functional genes in the Rps1-k locus. These genes will allow us to study the objectives proposed for understanding the molecular basis of the soybean-Phytopthora interaction.

Identification of the Rps1-k gene through complementation analysis: Rps1-k was mapped to a region physically spanned by three overlapping bacterial artificial chromosomes (BAC), BAC18, BAC43, and BAC99 (Bhattacharyya et al., 2003). Five highly identical coiled-coil NBS-LRR-type genes were identified by subcloning and sequencing of these three BACs. The genes were grouped into two classes, each carrying either two or three identical genes. Open reading frames (ORFs) of members of the Rps1-k gene family share 93-100% nucleotide and 89.9-100% amino acid sequence identity and carry no introns. One hundred and five variable positions, aside from 3 deletions of 1, 2, and 21 amino acids were identified in ORFs. Thirty-four variable positions were found at the N terminus (C-C motif and NBS domain) and 71 at the C terminus (LRR domain) of the protein. Only two alternative residues were found in all variable positions. These variable positions or informative polymorphic sites (IPSs) allowed us to group five genes into two distinct classes of identical genes. There are three deletions in the 5'-end region, and 6 and 84 IPSs at the 5'- and 3'-end regions, respectively (FIG. 14 of example 2).

Three genes, Rps1-k-1, -3, and -5, with identical ORFs represent one class, whereas Rps1-k-2 and Rps1-k-4 represent the other. Rps1-k-1 and -5 are identical genes but were cloned from nonovrelapping BAC18, and 99. Rps1-k-3 is a unique gene, because a recombination breakpoint was identified at its 3'-end region between 302 and 478 nucleotides (nts) downstream from the stop codon. Rps1-k-2 and -4 were distinguished by a single nt deletion in Rps1-k-2 at position 1900 nts downstream from the stop codon. Identical sequences among genes isolated from about 300 kb contiguous DNA of the Rps1-k locus made it difficult to identify all members of the gene family. We conclude that at least five genes are located at the Rps1-k locus. There are about 33 additional copies of the gene family next to the BAC18 side of the Rps1-k locus and were not studied, because a recombination event separated these genes from the Rps1-k locus. (Bhattacharyya et al., 2002).

To establish the functional identity, two members Rps1-k-2 and -3, one from each class, were introduced into soybean cv. Williams 79 (Rps1-c/Rps1-c) through *Agrobacterium*-mediated transformation procedures (Zhang et al., 1999b; in collaboration with Dr. K. Wang). $R_1$ progeny populations of five independent $R_o$ plants for Rps1-k-2 and three for Rps1-k-3 were evaluated by leaf and root inoculation procedures. Progenies of only one out of five independent transgenic plants carrying Rps1-k-2 showed *Phytophthora* resistance, while progenies of all three independent transgenic plants carrying Rps1-k-3 expressed resistance.

Influence of Rps1-k in the global gene transcription through a signal pathway(s) in conferring broad-spectrum resistance: We are interested in studying whether overexpression of Rps1-k results in broad-spectrum resistance against four selected diverse pathogens through activation of a single signal-transduction pathway.

Generation of transgenic soybean plants: Transcripts of the Rps1-k gene family are very rare. Screening of over four million independent lambda clones carrying cDNAs prepared from uninfected etiolated hypocotyls resulted in isolation of only four cDNAs. To discover genes that are regulated by an Rps1-k-activated signal pathway, Rps1-k will be overexpressed in stable transgenic plants. Overexpression of resistance genes has been shown to activate defense mechanisms and broadspectrum resistance (e.g. Tang et al., 1999). Transgenic soybean lines will be generated by transforming the susceptible cultivar Williams (rps1-k) with Rps1-k-3, regulated by either the cauliflower mosaic virus (CaMV) 35S promoter, or an alcohol inducible promoter (alc) (Roslan et al., 2001). Vector control plants will include transgenic plants carrying only either the alcohol inducible promoter, or the CaMV35S promoter. In *Arabidopsis* it has been shown that 2% alcohol was optimal for the maximum activity of the alc-promoter that was fused to the GUS gene (Roslan et al., 2001). Alcohol at a similar concentration is also expected to activate the alc-promoter in soybean. We investigated if alcohol affects the expression of *Phytophthora* resistance encoded by Rps1-k. Alcohol at varying concentrations was fed through roots of two-week old seedlings for 16 hours before inoculation. At high concentrations, alcohol made soybean plants more susceptible to *P. sojae* in the absence of Rps1-k. However, the expression of Rps1-k-encoded resistance was not affected by the treatment with 5% alcohol (FIG. 13). The mechanism of this alcohol-induced susceptibility is unknown. The results indicate that the alc-promoter should be applicable to overproduce Rps 1-k because the resistant response is stable even with 5% alcohol treatment.

In addition to the promoter fusion approach described above transgenic plants carrying all five Rps-1-k genes under their own promoters are being generated in Williams. Evaluation of a large collection of transgenic plants carrying members of the Rps1-k gene family is expected to result in at least a single transgenic plant that may carry a higher level of Rps1-k transcripts than that in the nontransgenic wild-type cultivar Williams 82 (Rps1-k). Integration of transgenes into transcriptionally active regions is thought to cause enhanced transcript accumulation. Broad-spectrum resistance developed from overexpression of the Prf gene in transgenic tomatoes resulted from this phenomenon (Oldroyd and Staskawicz, 1998). We expect to observe similar results from overexpression in transgenic soybeans. During the analysis of $R_1$ plants (Table 1) we identified three individual plants that showed much smaller lesions than those of Williams 82 (FIG. 14). $R_2$ progenies of these plants are currently being grown and will be evaluated for disease phenotypes and Rps1-k-2 and -3 transcript levels. If these $R_2$ plants show an immune-type response like that in $R_1$s, they will be evaluated for broad-spectrum resistance against selected pathogens.

FIG. 13. Lesion development following feeding of soybean seedlings with ethanol. Data were taken 72 h following inoculation. S, Williams inoculated with *P. sojae* race 1;

Functional Genomics of the Soybean-*Phytophthora sojae* Interaction.

We are interested in investigating the changes in gene expression that occur almost immediately following infection. The progression of disease development in etiolated tissues following inoculation with *P. sojae* zoospores is extremely rapid and one can detect accumulation of phytoalexins glyceollin isomers by 8 h following inoculation only in the resistant response not in the susceptible response (Bhattacharyya and Ward 1986a). Genes involved in the synthesis of glyceollin or other putative defense responses are induced by as early as 2 /2 h following infection (Esnault et al., 1987; Liu et al., 2001). A cDNA library (Gm-c1084) was constructed from equal amounts of poly($A^+$) RNAs isolated from 2 to 4 h following inoculation of etiolated Williams 82 hypocotyls with *P. sojae* race 1 zoospores. In collaboration with Dr. Randy Shoemaker, Iowa State University, we have sequenced this cDNA library (www.129.186.26.94/soybean%20EST/libraries/Gm-c1084.ntml). Over six thousands cDNA clones were selected and sequenced, and 4737 ESTs were deposited in the GenBank.

ESTs isolated from the Gm-c1084 library were compared with 152,000 ESTs isolated from unstressed soybean cDNA libraries and we identified 227 unique genes that were only found in the Gm-c1084 library. Presumably these genes are not transcribed in uninfected or unstressed tissues (D. Grant, R. C. Shoemaker and M. K. Bhattacharyya, unpublished). To validate the expression of these 227 genes in infected tissues, DNA samples were prepared by a Montage Kit supplied by Millipore, Inc. (Bedford, Mass.) and DNA from each EST clone was spotted twice onto nylon membranes. Reverse transcribed radiolabeled cDNAs prepared from uninfected and infected tissues were then used to hybridize these EST clones spotted on nylon membranes. This experiment is in progress. Gm-c1084 library-specific clones will be included in the set of unigenes used for preparing microarrays of soybean EST sequences in the Vodkin Laboratory.

FIG. 14. Immune responses shown by R1 progenies. a. Williams 82 (Rps1-k) trifoliates showing normal resistant response. b and d, trifoliates from two independent $R_1$ plants of an $R_o$ plant ST20-S1-1-1B carrying Rp1-k-3. c, trifoliates from the $R_o$ plant ST22-S1-37C carrying Rp1-k-2. Arrows are used to show poor HR development among transgenic plants.

The rationale of the proposed research is that once it is known how the expression of resistance of soybean against its pathogens takes place, engineering of broad-spectrum resistance will be feasible, and thus, productivity of soybeans will increase without the use of toxic pesticides. Understanding of the signal transduction process and its components is very central to achieving this goal.

The signal pathway involved in disease resistance can be understood by studying the Rps1-k-overexpressed plants. Overexpression of the disease resistance gene Rps1-k is expected to activate a common signal pathway that alters the global gene expression and induces broad-spectrum resistance against soybean pathogens. Changes in the global gene transcription in Rps1-k-overexpressed transgenic soybean plants are expected to identify downstream novel pathways or genes that are important for induction of the broad-spectrum resistance.

As stated earlier, the annual yield loss of soybean in the United States from the *Phytophthora* root and stem rot disease is valued at about 120 million dollars and from all diseases and pests together at nearly one billion dollars (Wrather et al., 1997). The proposed research is significant, because it will advance our knowledge of the signal transduction process in the expression of resistance against *P. sojae* and other pathogens and will contribute significantly towards generating broad-spectrum resistance. This research will lead to cloning of genes involved in signal transduction for expression of. defense compounds and also novel genes involved in the expression of resistance. Manipulation of these genes in transgenic soybean plants and their corresponding orthologous genes in other crop species should generate broad-spectrum resistance against plant pathogens. Collectively, the research proposed in this application is very significant, because it is expected to contribute towards engineering broad-spectrum resistance to many soybean pathogens, which will mean greater profitability for the soybean farmers and cleaner environment. The knowledge obtained in this investigation should be applicable to other host-pathogen interactions in generating broad-spectrum resistance against serious diseases of agronomic importance.

The proposed research, therefore, is expected to have a significant positive effect on agriculture, because it has the potential of saving hundreds of millions of dollars in annual crop losses due to diseases and resulting in a cleaner environment; and, therefore, will contribute significantly to the long-term sustainability of U.S. agriculture.

We are in the process of developing transgenic lines carrying Rps1-k-3 under the control of either the strong constitutive 35S promoter or an alcohol inducible promoter. $R_1$ progenies of these transgenic plants will be analyzed for transcripts and homozygous $R_2$ progenies (Rps1-k-3, Rps1-k-3) for the extent of broad-spectrum resistance. We have recently harvested a limited number of $R_2$ seeds from the complemented transgenic lines showing immune-type responses (FIG. 14). These plants will be evaluated for transcript levels of the transgene and also for the extent of broad-spectrum resistance against *P. sojae* races. Currently we are also generating additional transgenic lines carrying all five members of the Rps1-k gene family, and R1 progeny of those transgenic plants will be evaluated in 2003. If we fail to reach our goal from promoter-gene fusion experiments described above or plants shown in FIG. 14, progenies of these lines carrying individual members of the gene family will be evaluated for broad-spectrum resistance. The working hypothesis for this objective is that overexpression of an Rps1-k gene will change the global gene transcription pattern for inducing broad-spectrum resistance against soybean pathogens.

Experimental Design

Development of transgenic lines and analysis of transcript levels for Rps1-k: Ten independent transgenic Williams lines will be generated for Rps1-k-3 under control of either the strong constitutive promoter CaMV35S, or an alcohol-inducible promoter. Northern blot analysis and/or RT-PCR experiments will be carried out to determine the Rps1-k-3 transcript levels among the transgenic $R_1$ lines. $R_2$ homozygous progenies of the $R_1$ lines showing high Rps1-k-3 transcript levels will be evaluated along with proper vector control plants for the extent of broad-spectrum resistance against *P. sojae* races and three other soybean pathogens: soybean mosaic virus (SMV), *Pseudomonas syringae* pv. *glycinea* (Psg), and soybean cyst nematodes (SCN). The transgenic lines showing broad-spectrum resistance will then be evaluated for changes in the pattern of global gene transcription and biochemical traits that may be involved in the expression of disease resistance. Transgenic soybean plants will be analyzed by Southern blot analysis to estimate the number of integrated transgene copies.

Extent of broad-spectrum resistance against soybean pathogens: $R_2$ transgenic lines showing elevated levels of the Rps1-k-3 transcript will be evaluated for the extent of induced resistance against virulent races or isolates of *P. sojae*, SMV, Psg, and SCN. The level of resistance in three homozygous $R_2$ families (Rps1-k-3, Rps1-k-3) descended from three independent $R_o$ plants will be compared to that of the $R_2$ families of vector transformed control plants. We will collaborate with Dr. J. Hill to screen these plants for SMV resistance while with Dr. G. Tylka for SCN resistance.

Resistance to *Phytophthora sojae* races: Hypocotyls of 20 etiolated seedlings and unifoliate leaves of five seedlings from each homozygous $R_2$ family will be inoculated with zoospores of race 25 that is virulent against Williams 82 (Rps1-k) (Bhattacharyya and Ward 1986b; Ward et al., 1979). Root inoculation will be carried out by germinating 10 seeds in coarse vermiculites 1-1.5 cm above a layer of virulent *P. sojae* race 25, grown in diluted V8 agar plates for two weeks. Susceptible seedlings fail to grow in this assay. Levels of resistance in hypocotyls or leaves will be expressed as inverse of percent lesion length/day over that in vector control transgenic plants. For root assay it will be expressed in percent stem length/day over that in vector control transgenic plants.

Resistance to *Pseudomonas syringae* pv. *glycinea:*

Bacterial blight disease caused by Psg is a foliage disease; and soybean can be protected effectively by growing resistant cultivars. There are at least four resistance genes (Rpg) that confer race-specific resistance against Psg (Keen and Buzzell 1991). Inoculation of unifoliate leaves from 10 seedlings of each $R_2$ family will be carried out using a Psg strain that is virulent against the cultivar Williams and levels of resistance will be expressed as inverse of percent lesion length/day over that in vector control transgenic plants (Keen and Buzzell 1991).

Resistances to Soybean Mosaic Virus:

SMV is one of the common diseases of soybean that causes yield reduction and seed-quality deterioration. Growing resistance cultivars has been considered to be the most effective method of controlling this pathogen. Resistance is conferred by single genes (Rsv) that are SMV strain-specific. Rsv1 has been mapped and NBS-LRR-type resistance gene sequences tightly linked to this gene have been identified (Yu at al. 1996; Gore et al., 2002). Hill Lab, Iowa State University, developed an immunocapture reverse transcription polymerase chain reaction (Ag-RT/PCR) method for SMV. It is highly sensitive and quantitative and will be used in determining the extent of SMV spread in infected soybean plants (Nolasco et al., 1993). Inoculation of leaves from 10 seedlings of each $R_2$ family with a SMV strain virulent to Williams will be carried out in collaboration with Dr. Hill. Broad-spectrum resistance of the selected $R_2$ lines will be expressed as inverse of percent RT-PCR product amounts over that in vector control transgenic plants. Real-time RT-PCR will be carried out for accurate determination of the virus transcripts.

Resistance to Soybean Cyst Nematodes:

SCN (*Heterodea glycines*) is regarded as the most damaging pathogen of soybean, causing annual crop losses of over 300 million dollars (Doupnik, 1993; Wrather et al., 1997). SCN is a soil-born pathogen. In the soil, nematode eggs undergo embryogenesis and develop through one molt into second stage juveniles, which hatch and migrate through the soil in search of susceptible plants. Resistance of soybean to SCN has been shown to offer great promise in reducing crop losses from SCN. Twenty seedlings from each $R_2$ family will be evaluated for resistance against a SCN race that is virulent against Williams and quantified according to the method of Schmitt and Shannon (1992) and expressed as inverse of percent galls formed over that in vector control plants.

Characterization of Transgenic Lines for Global Gene Transcription and Other Cellular and Metabolic Changes:

We will characterize transgenic lines with high Rps1-k transcript levels and broad-spectrum resistance for changes in i) the pattern of global gene transcription, ii) phenotypes at the cellular or tissues levels, and iii) metabolites that are considered as signal transducing effectors.

Global gene regulation will be studied for transgenic lines with the highest level of Rps1-k transcripts and broad-spectrum resistance. To date, 301,734 soybean ESTs are available in GenBank and 9,216 unigenes have been identified (L. Vodkin, personal communication). The publicly funded soybean EST project has allowed us to sequence the Gm-c1084 cDNA library, constructed from the incompatible soybean-*P. sojae* interaction. Microarray analysis will be carried out in collaboration with Dr. L. Vodkin, University of Illinois. Methods for microarray analysis have been established (www.soybeangenomics.cropsci.uiuc.edu/protocols/index.html). To date, microarrays carrying 9,216 unigenes (www.soybeangenomics.cropsci.uiuc.edu/files/NSF Web Overview.PDF) are available at the Vodkin Lab. It is expected that Vodkin lab will be in a position to print DNA microarrays containing approximately 30,000 unique genes, including those from the Gm-c1084 cDNA library, by the summer of 2003 (Vodkin, personal communication) and will be used for the following treatments: (i) *P. sojae* race 1 infected transgenic $R_2$ Williams (Rps1-k-3) plants showing broad-spectrum resistance; (ii) water control for the transgenic $R_2$ Williams (Rps1-k-3) plants showing broad-spectrum resistance; (iii) *P. sojae* race 1 infected vector-transformed $R_2$ Williams (rps1-k) plants; (iv) water control for the vector-transformed $R_2$ Williams (rps1-k) plants; (v) *P. sojae* race 1 infected transgenic $R_2$ Williams (Rps1-k-3) plants showing only the Rps1-k-3-specific phenotype; (vi) water control for transgenic $R_2$ Williams (Rps1-k-3) plants showing only the Rps1-k-specific phenotype.

Poly($A^+$) RNAs for microarray analyses will be prepared from etiolated hypocotyl tissues harvested 4 h following either treatment with water droplets or inoculated with *P. sojae* race 1 zoospore suspensions (Bhattacharyya, 2001; Ward et al., 1979). Probes will be prepared from poly($A^+$) RNAs and hybridized to microarrays in the Vodkin Lab. Three independent experiments will be conducted to eliminate any experimental variation. Images will be quantified with software packages such as Scanalyse or GenePix, which are in use at the University of Illinois and Iowa State University. An inherent part of this gene expression analysis is the within-slide variability in incorporation and/or detection of fluorescent probe in the hybridization process. The Vodkin Lab has developed a procedure for normalization of array data that simultaneously corrects itself for sources of variation using an analysis of variance approach. Microarray analysis data will be validated by carrying out reverse northern or northern blot analyses for 30 randomly selected genes.

Changes in phenotypes at the cellular or tissue level will be determined through microscopic analyses of the transgenic plants for cell death or accumulation of autofluorescent compounds. Any changes in autofluorescent materials will be determined by following standard procedures (Dietrich et al., 1994; Shigaki and Bhattacharyya, 2000).

Levels of salicylic acid content, the signal molecule for systemic acquired resistance, will be determined according to protocol described by Bowling et al., (1994).

Over-expression of Rps1-k-3 is expected to induce broad-spectrum resistance by eliciting a signal pathway(s) that regulates gene transcription involved in enhancing the accumulation of products that are shown to be associated with the expression of resistance. Microarray analysis should characterize alterations in global gene transcription associated with the expression of broad-spectrum resistance. Thus, the analysis of global gene transcription and determination of levels of candidate metabolites among Rps1-k overexpressed plants will result in a better understanding of the extent to which a common signal pathway influences the expression of defense responses against a wide array of pathogens.

Transgenic soybean lines showing varying levels of Rps1-k transcripts will be developed. Increased Rps1-k transcripts are expected to induce defense through the signal pathway and to result in broad-spectrum resistance against the four diverse pathogens. This will establish that a single signal pathway is involved in the expression of resistance against diverse pathogens. Lines with broad-spectrum resistance will be utilized to investigate the extent of changes in global gene transcription due to overproduction of Rps1-k. This functional genomics approach will assist to understand the metabolic pathways that are altered in conferring broad-spectrum resistance. Such information is important to better understand the mechanisms of disease resistance. Novel genes identified in the functional genomics study could be utilized in developing improved soybean germplasm.

REFERENCES

Aarts, N., Metz, M., Holub, E., Staskawicz, B. J., Daniels, M. J., and Parker, J. E. 1998. Different requirements for EDS1 and NDR1 by disease resistance genes define at least two R gene-mediated signaling pathways in *Arabidopsis*. Proc Natl Acad Sci USA. 95:10306-10311.

Anandalakshmi, R., Pruss, G. J., Ge, X., Marathe, R., Mallory, A. C., Smith, T. H., and Vance, V. B. 1998. A viral suppressor of gene silencing in plants. Proc Natl Acad Sci USA. 95:13079-13084.

Anderson, P. A., Lawrence, G. J., Morrish, B. C., Ayliffe, M. A., Finnegan, E. J., and Ellis, J. G. 1997. Inactivation of the flax rust resistance gene M associated with loss of a repeated unit within the leucine-rich repeat coding region. Plant Cell 9:641-651.

Anderson, T. R., and Buzzell, R. I. 1992. Inheritance and linkage of the Rps7 gene for resistance to *Phytophthora* rot of soybean. Plant Disease 76:958-959.

Azevedo, C., Sadanandom, A., Kitagawa, K., Freialdenhoven, A., Shirasu, K., Schulze-Lefert, P. 2002. The RAR1 interactor SGT1, an essential component of R gene-triggered disease resistance. Science 295:2073-2076.

Bhattacharyya M. K., Narayanan N. N., Salimath S. S., Santra D. Gao H., Ellison L, Kasuga, T., Liu Y., Espinosa B., Marek L. F., Shoemaker R. C., Gijzen M. and Buzzell R. I. 2003. Positional cloning and organization of members of the Rps1-k gene family in soybean. Genetics, to be resubmitted.

Bhattacharyya, M. K., and Ward, E. W. B. 1986a. Resistance, susceptibility and accumulation of glyceollins I-III in soybean organs inoculated with *Phytophthora megasperma* f.sp. glycinea. Physiological and Molecular Plant Pathology 29:227-237.

Bhattacharyya, M. K., and Ward, E. W. B. 1986b. Expression of gene-specific and age-related resistance and the accumulation of glyceollin in soybean leaves infected with *Phytophthora megasperma* f.sp. glycinea. Physiological and Molecular Plant Pathology 29:105-113.

Bhattacharyya, M. K., and Ward, E. W. B. 1988. Phenylalanine ammonia-lyase activity in soybean hypocotyls and leaves following infection with *Phytophthora megasperma* f.sp. glycinea. Canadian Journal of Botany 66:18-23.

Bent, A. F., Kunkel, B. N., Dahlbeck, D., Brown, K. L., Schmidt, R., Giraudat, J., Leung, J., and Staskawicz, B, J. 1994. RPS2 of *Arabidopsis thaliana*: a leucine-rich repeat class of plant disease resistance genes. Science 265(5180): 1856-60.

Bogdanove, A. J., and Martin, G. B. 2000. AvrPto-dependent Pto-interacting proteins and AvrPto-interacting proteins in tomato. Proc Natl Acad Sci USA 97:8836-40.

Bowling, S. A., Guo, A., Cao, H., Gordon, A. S., Klessig, D. F., and Dong, X. 1994. A mutation in *Arabidopsis* that leads to constitutive expression of systemic acquired resistance. Plant Cell 6:1845-1857.

Brueggeman, R., Rostoks, N., Kudrna, D., Kilian, A., Han, F., Chen, J., Druka, A., Steffenson, B., and Kleinhofs, A. 2002. The barley stem rust-resistance gene Rpg1 is a novel disease-resistance gene with homology to receptor kinases. Proc Natl Acad. Sci. USA 99:9328-9333.

Burnham, K. D., A. E. Dorrance, D. M. Francis, R. J. Fioritto, and S. K. St. Martin. 2003. Rps8, a new locus in soybean for resistance to *Phytophthora sojae*. Crop Sci 43:101-105.

Cao, H., Li, X., and Dong, X. 1998. Generation of broad-spectrum disease resistance by overexpression of an essential regulatory gene in systemic acquired resistance. Proc Natl Acad Sci. USA 95:6531-6536.

Century, K. S., Holub, E. B., and Staskawicz, B. J. 1995. NDR1, a locus of *Arabidopsis thaliana* that is required for disease resistance to both a bacterial and a fungal pathogen. Proc Natl Acad Sci. USA 92:6597-6601.

Century, K. S., Shapiro, A. D., Repetti, P. P., Dahlbeck, D., Holub, E., and Staskawicz, B. J. 1997. NDR1, a pathogen-induced component required for *Arabidopsis* disease resistance. Science 278:1963-1965.

Dietrich, R. A., Delaney, T. P., Uknes, S. J., Ward, E. R., Ryals, J. A., and Dangl, J. L. 1994. *Arabidopsis* mutants simulating disease resistance response. Cell 77:565-577.

Dixon, M. S., Golstein, C., Thomas, C. M., van Der Biezen, E. A., and Jones, J. D. 2000. Genetic complexity of pathogen perception by plants: the example of Rcr3, a tomato gene required specifically by Cf-2. Proc Natl Acad Sci USA 97:8807-8814.

Dixon, M. S., Jones, D. A., Keddie, J. S., Thomas, C. M., Harrison, K., and Jones, J. D. G. 1996. The tomato Cf-2 disease resistance locus comprises two functional genes encoding leucine-rich repeat proteins. Cell 84:451-459.

Doupnik, J., B. 1993. Soybean production and disease loss estimates for North Central United States from 1989 to 1991. Plant Disease 77:1170-1171.

Ebel, J., and Grisebach, H. 1988. Defense strategies of soybean against the fungus *Phytophthora megasperma* f.sp. glycinea: a molecular analysis. Trends Biochem Sci. 13:23-27.

Ellis, J. G., Lawrence, G. J., Luck, J. E., and Dodds, P. N. 1999. Identification of regions in alleles of the flax rust resistance gene L that determines differences in gene-for-gene specificity. Plant Cell 11:495-506.

Enkerli, K., Hahn, M. G., and Mims, C. W. 1997. Ultrastructure of compatible and incompatible interactions of soybean roots infected with the plant pathogenic oomycete *Phytophthora sojae*. Canadian J. Bot. 75:1493-1508.

Esnault, R., Chibbar, R. N., Lee, D., Van Huystee, R. B., and Ward, E. W. B. 1987. Early differences in production of mRNAs for phenylalanine ammonia-lyase and chalcone synthase in resistant and susceptible cultivars of soybean inoculated with *Phytophthora megasperma* f.sp. glycinea. Physiol. and Mol. Plant Pathol. 30:293-297.

Falk, A., Feys, B. J., Frost, L. N., Jones, J. D. G., Daniels, M. J., and Parker, J. E. 1999. EDS1, an essential component of R gene-mediated disease resistance in *Arabidopsis* has homology to eukaryotic lipases. Proc Natl Acad Sci. USA 96:3292-3297.

Flor, H. H. 1955. Host-parasite interaction in flax rust—its genetics and other implications. Phytopathology 45:680-685.

Frame, B. R., Shou, H., Chikwamba, R. K., Zhang, Z., Xiang, C., Fonger, T. M., Pegg, S. E., Li, B., Nettleton, D. S., Pei, D., and Wang, K. 2002. *Agrobacterium tumefaciens*-mediated transformation of maize embryos using a standard binary vector system. Plant Physiol. 129:13-22.

Freialdenhoven, A., Scherag, B., Hollricher, K., Collinge, D. B., Thordal-Christensen, H., and Schulze-Lefert, P. 1994. Nar-1 and Nar-2, two loci required for $Mla_{12}$-specified race-specific resistance to powdery mildew in barley. Plant Cell 6: 983-994.

Gore, M. A., Hayes, A. J., Jeong, S. C., Yue, Y. G., Buss, G. R., Maroof, S. 2002. Mapping tightly linked genes controlling potyvirus infection at the Rsv1 and Rpv1 region in soybean. Genome 45:592-599.

Graham, T. L. 1995. Cellular biochemistry of phenylpropanoid responses of soybean to infection by *Phytophthora sojae*, p. 85-116, In M. Daniel and R. P. Purkayastha, eds. Handbook of phytoalexin metabolism and action. Marcel Dekker, New York.

Grant, M. R., Godiard, L., Straube, E., Ashfield, T., Lewald, J., Sattler, A., Innes, R. W., and Dangl, J. L. 1995. Structure of the *Arabidopsis* RPM1 gene enabling dual specificity disease resistance. Science 269:843-846.

Hammond-Kosack, K. E., Jones, D. A., and Jones, J. D. G. 1994. Identification of two genes required in tomato for full Cf-9-dependent resistance to *Cladosporium fulvum*. Plant Cell 6:361-374.

Hoffman, T., Schmidt, J. S., Zheng, X., and Bent, A. F. 1999. Isolation of ethylene-insensitive soybean mutants that are altered in pathogen susceptibility and gene-for-gene disease resistance. Plant Physiol. 119:935-949.

Jia, Y., McAdams, S. A., Bryan, G. T., Hershey, H. P., and Valent, B. 2000. Direct interaction of resistance gene and avirulence gene products confers rice blast resistance. EMBO 19:4004-4014.

Jones, D. A., Thomas, C. M., Hammond-Kosack, K. E., Balint-Kurti, P. J., and Jones, J. D. G. 1994. Isolation of the tomato Cf-9 gene for resistance to *Cladosporium fulvum* by transposon tagging. Science 266:789-793.

Jørgensen, J. H. 1988. Genetic analysis of barley mutants with modifications of powdery mildew resistance gene Mla-12. Genome 30: 129 132.

Jørgensen, J. H. 1996. Effect of three suppressors on the expression of powdery mildew resistance genes in barley. Genome 39: 492-498.

Kanazin, V., Marek, L. F., and Shoemaker, R. C. 1996. Resistance gene analogs are conserved and clustered in soybean. Proc Natl Acad. Sci. USA 93:11746-11750.

Kasuga, T., Salimath, S. S., Shi, J., Gijzen, M., Buzzell, R. I., and Bhattacharyya, M. K. 1997. High resolution genetic and physical mapping of molecular markers linked to the *Phytophthora* resistance gene Rps1-k in soybean. Molecular Plant-Microbe Interactions 10:1035-1044.

Keen, N. T., and Yoshikawa, M. 1990. The expression of resistance in soya beans to *Phytophthora megasperma* f.sp. glycinea, p. 329-344, In D. Hornby, et al., eds. Biological Control of Soil-Borne Plant Pathogens. CAB International, Wallingford, Oxon, United Kingdom.

Keen, N. T., and Buzzell, R. I. 1991. New disease resistance genes in soybean agaainst *Pseudomonas syringae* pv glycinea: evidence that one of them interacts with a bacterial elicitor. Theor Appl Genet. 81:133-138.

Kim, Y. J., Lin, N. C., and Martin, G. B. 2002. Two distinct *Pseudomonas* effector proteins interact with the Pto kinase and activate plant immunity. Cell 109:589-598.

Lawrence, G. J., Finnegan, E. J., Ayliffe, M. A., and Ellis, J. G. 1995. The L6 gene for flax rust resistance is related to the *Arabidopsis* bacterial resistance gene RPS2 and the tobacco viral resistance gene N. Plant Cell 7:1195-1206.

Leister, R. T., Ausubel, F. M., and Katagiri, F. 1996b. Molecular recognition of pathogen attack occurs inside of plant cells in plant disease resistance specified by the *Arabidopsis* genes RPS2 and RPM1. Proc Natl Acad Sci. USA 93:15497-15502.

Liu, Y., Dammann, C. and Bhattacharyya, M. K. 2001. The matrix metalloproteinase gene GmMMP2 is activated in response to pathogenic infections in soybean. *Plant Physiol.* 127:1788-1797.

Luck, J. E., Lawrence, G. J., Dodds, P. N., Shepherd, K. W., and Ellis, J. G. 2000. Regions outside of the leucine-rich repeats of flax rust resistance proteins play a role in specificity determination. Plant Cell. 12:1367-1377.

Mallory, A. C., Parks, G., Endres, M. W., Baulcombe, D., Bowman, L. H., Pruss, G. J., and Vance, V. B. 2002. The amplicon-plus system for high-level expression of transgenes in plants. Nat Biotechnol. 20:622-625.

Martin, G. B., Brommonschenkel, S. H., Chunwongse, J., Frary, A., Ganal, M. W., Spivey, R., Wu, T., Earle, E. D., and Tanksley, S. D. 1993. Map-based cloning of a protein kinase gene conferring disease resistance in tomato. Science 262:1432-1436.

Meyers, B. C., Shen, K. A., Rohani, P., Gaut, B. S., and Michelmore, R. W. 1998. Receptor-like genes in the major resistance locus of lettuce are subject to divergent selection. Plant Cell 10:1833-1846.

Meyers, B. C., Dickerman, A. W., Michelmore, R. W., Sivaramakrishnan, S., Sobral, B. W., and Young, N. D. 1999. Plant disease resistance genes encode members of an ancient and diverse protein family within the nucleotide-binding superfamily. Plant Journal 20:317-332.

Mindrinos, M., Katagiri, F., Yu, G.-L., and Ausubel, F. M. 1994. The *A. thaliana* disease resistance gene RPS2 encodes a protein containing a nucleotide-binding site and leucine-rich repeats. Cell 78:1089-1099.

Muskett, P. R., Kahn, K., Austin, M. J., Moisan, L. J., Sadanandom, A., Shirasu, K., Jones, J. D., and Parker, J. E. 2002 *Arabidopsis* RAR1 exerts rate-limiting control of R gene-mediated defenses against multiple pathogens. Plant Cell 14:979-992.

Nolasco, G., de Blas, C., Torres, and V., Ponz, F. 1993. A method combining immunocapture and PCR amplification in a microtiter plate for the detection of plant viruses and subviral pathogens. *J Virol Methods* 45: 201-218.

Oldroyd, G. E. D., and Staskawicz, B. J. 1998. Genetically engineered broad-spectrum disease resistance in tomato. Proc Natl Acad Sci. USA 95:10300-10305.

Ori, N., Eshed, Y., Paran, I., Presting, G., Aviv, D., Tanksley, S., Zamir, D., and Fluhr, R. 1997. The I2C family from the wilt disease resistance locus I2 belongs to the nucleotide binding, leucine-rich repeat superfamily of plant resistance genes. Plant Cell 9:521-532.

Pan, Q., Liu, Y. S., Budai-Hadrian, O., Sela, M., Carmel-Goren, L., Zamir, D., and Fluhr, R. 2000. Comparative genetics of nucleotide binding site-leucine rich repeat resistance gene homologues in the genomes of two dicotyledons: tomato and *arabidopsis*. Genetics 155:309-322.

Parker, J. E., Holub, E. B., Frost, L. N., Falk, A., Gunn, N. D., and Daniels, M. J. 1996. Characterization of eds1, a mutation in *arabidopsis* suppressing resistance to *Peronospora parasitica* specified by several different RPP genes. Plant Cell 8:2033-2046.

Parker, J. E., Coleman, M. J., Szabó, V., Frost, L. N., Schmidt, R., van der Biezen, E. A., Moores, T., Dean, C., Daniels, M. J., and Jones, J. D. G. 1997. The *Arabidopsis* downy mildew resistance gene RPP5 shares similarity to the toll and interleukin-1 receptors with N and L6. Plant Cell 9:879-894.

Parniske, M., Hammond-Kosack, K. E., Golstein, C., Thomas, C. M., Jones, D. A., Harrison, K., Wulff, B. B. H., and Jones, J. D. G. 1997. Novel disease resistance specificities result from sequence exchange between tandemly repeated genes at the Cf-4/9 locus of tomato. Cell 91:821-832.

Paxton, J. 1995. Soybean phytoalexins: Elicitation, nature, mode of action, and role, p. 69-83, In M. Daniel and R. P. Purkayastha, eds. Handbook of phytoalexin metabolism and action. Marcel Dekker, New York.

Polzin, K. M., Lorenzen, L. L., Olson, T. C., and Shoemaker, R. C. 1994. An unusual polymorphic locus useful for tagging Rps1 resistance alleles in soybean. Theor Appl Genet. 89:226-232.

Roslan, H. A., Salter, M. G., Wood, C. D., White, M. R., Croft, K. P., Robson, F., Coupland, G., Doonan, J., Laufs, P., Tomsett, A. B., and Caddick, M. X. 2001. Characterization of the ethanol-inducible alc gene-expression system in *Arabidopsis thaliana*. Plant J. 28:225-235.

Salmeron, J. M., Baker, S. J., Carland, F. M., Mehta, A. Y., and Staskawicz, B. J. 1994. Tomato mutants altered in bacterial disease resistance provide evidence for a new locus controlling pathogen recognition. Plant Cell 6:511-520.

Salmeron, J. M., Oldroyd, G. E. D., Rommens, C. M. T., Scofield, S. R., Kim, H.-S., Lavelle, D. T., Dahlbeck, D., and Staskawicz, B. J. 1996. Tomato Prf is a member of the leucine-rich repeat class of plant disease resistance genes and lies embedded within the Pto kinase gene cluster. Cell 86:123-133.

Schmitt, D. P., and Shannon, J. G. 1992. Differentiating soybean responses to *Heterodera glycines* races. Crop Sci 32:275-277.

Schmitthenner, A. F. 1989. *Phytophthora* rot, p. 35-38, In J. B. Sinclair and P. A. Backman, eds. Compendium of soybean diseases. APS Press, St. Paul, Minn.

Schmitthenner, A. F., Hobe, M., and Bhat, R. G. 1994. *Phytophthora sojae* races in Ohio over a 10-year interval. Plant Disease 78:269-276.

Scofield, S. R., Tobias, C. M., Rathjen, J. P., Chang, J. H., Lavelle, D. T., Michelmore, R. W., and Staskawicz, B. J. 1996. Molecular basis of gene-for-gene specificity in bacterial speck disease of tomato. Science 274:2063-2065.

Sessa, G. and Martin, G. B. 2000. Signal recognition and transduction mediated by the tomato Pto kinase: a paradigm of innate immunity in plants. Microbes Infect 2:1591-1597.

Shigaki, T., and Bhattacharyya, M. K. 1999. Color coding the cell death status of plant suspension cells. Biotechniques 26:1060-2.

Shirasu, K., Lahaye, T., Tan, M.-W., Zhou, F., Azevedo, C., and Schulze-Lefert, P. 1999. A novel class of eukaryotic zinc-binding proteins is required for disease resistance signaling in barley and development in *C. elegans*. Cell 99:355-366.

Song, W.-Y., Wang, G.-L., Kim, H.-S., Pi, L.-Y., Holsten, T., Gardner, J., Wang, B., Zhai, W.-X., Zhu, L.-H., Fauquet, C., and Ronald, P. 1995. A receptor kinase-like protein encoded by the rice disease resistance gene, Xa21. Science 270:1804-1806.

Tang, X., Frederick, R. D., Zhou, J., Halternan, D. A., Jia, Y., and Martin, G. B. 1996. Initiation of plant disease resistance by physical interaction of AvrPto and Pto kinase. Science 274:2060-2063.

Tang, X., Xie, M., Kim, Y. J., Zhou, J., Klessig, D. F., and Martin, G. B. 1999. Overexpression of Pto activates defense responses and confers broad resistance. Plant Cell 11: 15-29.

Thomas, C. M., Jones, D. A., Parniske, M., Harrison, K., Balint-Kurti, P. J., Hatzixanthis, K., and Jones, J. D. G. 1997. Characterization of the tomato Cf-4 gene for resistance to *Cladosporium fulvum* identifies sequences that determine recognitional specificity in Cf-4 and Cf-9. Plant Cell 9:2209-2224.

Tyler, B. M., Förster, H., and Coffey, M. D. 1995. Inheritance of avirulence factors and restriction fragment length polymorphism markers in outcrosses of the oomycete *Phytophthora sojae*. Mol Plant Microbe Interact. 8:515-523.

van der Biezen, E. A., Sun, J., Coleman, M. J., Bibb, M. J., and Jones, J. D. 2000. *Arabidopsis* RelA/SpoT homologs implicate (p)ppGpp in plant signaling. Proc Natl Acad Sci USA 97:3747-3752.

Ward, E. W. B. 1990. The interaction of soya beans with *Phytophthora megasperma* f.sp. glycinea: Pathogenicity, p. 311-327, In D. Hornby, ed. Biological Control of Soil-Borne Plant Pathogens. C. A. B. International, Wallingford, United Kingdom.

Ward, E. W. B., Cahill, D. M., and Bhattacharyya, M. K. 1989. Early cytological differences between compatible and incompatible interactions of soybeans with *Phytophthora megasperma* f.sp. glycinea. Physiol and Mol Plant Pathol 34:267-283.

Ward, E. W. B., Lazarovits, G., Unwin, C. H., and Buzzell, R. I. 1979. Hypocotyl reactions and glyceollin in soybeans inoculated with zoospores of *Phytophthora megasperma* var. *sojae*. Phytopathology 69:951-955.

Warren, R. F., Merritt, P. M., Holub, E., and Innes, R. W. 1999. Identification of three putative signal transduction genes involved in R gene-specified disease resistance in *Arabidopsis*. Genetics 152:401-412.

Warren, R. F., Henk, A., Mowery, P., Holub, E., and Innes, R. W. 1998. A mutation within the leucine-rich repeat domain of the *Arabidopsis* disease resistance gene RPS5 partially suppresses multiple bacterial and down mildew resistance genes. Plant Cell 10:1439-1452.

Whisson, S. C., Drenth, A., Maclean, D. J., and Irwin, J. A. G. 1994. Evidence for outcrossing in *Phytophthora sojae* and linking of a DNA marker to two avirulence genes. Current Genetics 27:77-82.

Whisson, S. C., Drenth, A., Maclean, D. J., and Irwin, J. A. 1995 *Phytophthora sojae* avirulence genes, RAPD, and RFLP markers used to construct a detailed genetic linkage map. Mol Plant Microbe Interact. 8:988-995.

Whitham, S., Dinesh-Kumar, S. P., Choi, D., Hehl, R., Corr, C., and Baker, B. 1994. The product of the tobacco mosaic virus resistance gene N: Similarity to toll and the interleukin-1 receptor. Cell 78:1101-1115.

Williams, J. G. K., Kubelik, A. R., Livak, K. J., Rafalski, J. A., and Tingey, S. V. 1990. DNA polymorphisms amplified by arbitrary primers are useful as genetic markers. Nucleic Acid Research 18:6531-6535.

Wrather, J. A., Anderson, T. R., Arsyad, D. M., Gai, J., Ploper, L. D., Porta-Puglia, A., Ram, H. H., and Yorinori, J. T. 1997. Soybean disease loss estimates for the top 10 soybean producing countries in 1994. Plant Disease 81:107-110.

Yu, Y. G., Buss, G. R., and Maroof, M. A. S. 1996. Isolation of a superfamily of candidate disease-resistance genes in soybean based on a conserved nucleotide-binding site. Proc Natl Acad Sci. USA 93:11751-11756.

Zhang, Y., Fan, W., Kinkema, M., Li, X., Dong, X. 1999. Interaction of NPR1 with basic leucine zipper protein transcription factors that bind sequences required for salicylic acid induction of the PR-1 gene. Proc Natl Acad Sci USA. 96:6523-6528.

Zhang, Z., Xing, A. Staswick, P., Clemente, T. 1999b. The use of glufosinate as a selective agent in *Agrobacterium*-mediated transformation of soybean. Plant Cell Tiss Org Cult 56:37-46.

Zhou, J., Loh, Y.-T., Bressan, R. A., and Martin, G. B. 1995. The tomato gene Ptil encodes a serine/threonine kinase that is phosphorylated by Pto and is involved in the hypersensitive response. Cell 83:925-935.

Zhou, J. M., Trifa, Y., Silva, H., Pontier, D., Lam, E., Shah, J., Klessig, D. F. 2000. NPR1 differentially interacts with members of the TGA/OBF family of transcription factors that bind an element of the PR-1 gene required for induction by salicylic acid. Mol Plant Microbe Interact 13:191-202.

Example 4

Rpsl-k-1
>Rpsl-k-1_5'END (SEQ ID NO: 159)
TCACTGAATATATTAATAATAAAATTTTTATATAAATAAGATTCAAAGGATAATCACCAACCAAGAAATTTTATGGA

AGTATTTATCAAATAATTACAATAGATATATAACATAAAAAAAAGAGTTGAATTGAATAATAATTTTTCATGCCATC

ATTTCAAAAGAATTACTTTAATCACTCTCTTTATATTATTATTATTATTATTATAACATCTTCACAATATTTTTTATTTT

ATTAGTATTATTGATTTTATTAATAAAAAATCACACACTTTTCTTTTTGCACACATCTTTAATCTACATATAAGGAT

ATTCAAATCTTGACTTCATTAATATATATATTATTGTTTTTAGGGATCAATTAGCATGTGTCTTTTCTTTAATTCTTTCTCT

TTTAATTTGTTCAACATCTTTTATTGTGTTAATAATTTTTTAATCTCATTTTTTTATTTTCCTCCTAACAAAATTTATTC

TATATATAAGAATTAATAAAGATTTAAATCTTTTACCACTTGATTAAAAAACATAAATTACTATCAATTATTTTAACT

TTTTATAAAATCATGATTCAGATCTTTATACAATAACATATCTCATCATGTGTTAGTTGTTTATATCATCACTCTTTAA

ATCTCTTGAGTCTTTAGTTTAGAGGAGCTAAATTCAAAATAGAAATATCAAGAAAGTAACATATGTGAGGATCAAAA

GTAAAGAGACTCCCAACGTGATAAGTCACCCACCACCATAATAATACAAATAATAAAAATAAAAAAGACCATACTT

TTGTCTTGCACAGCAGAACGAGTGAAGGTGAAGAGAGTTGACTTAAGCCAAATCTCATCACATCAGTTCATAGCAAC

CAATTCCCTTGCCTTTGTCTTTCTACTCTGATCATCTTTTGTTCTTGAGATA

>Rpsl-k-1_ORF (SEQ ID NO: 1)
ATGGCTGCAGCACTGGTCGGTGGTGCCTTTCTCTCTGCTTTCCTTGATGTGCTTTTCGACAGGCTGGCTTCACCTGAC

TTTGTTGACTTGATCCTTGGAAAGAAGCTTAGCAAGAAGTTGCTTCGAAAGTTGGAGACCACTCTCAGAGTGGTTGG

AGCTGTGCTTGATGATGCCGAGAAGAAACAGATCACAAACACCAATGTCAAACACTGGCTCAATGCTCTCAAAGAT

GCTGTCTATGAAGCCGATGACTTACTCGACCATGTTTTCACCAAAGCTGCCACCCAAAACAAGGTAAGAAACTTGTT

TTCTCGCTTTTCCGATCGGAAGATCGTTAGTAAGTTGGAGGACATAGTTGTCACCCTAGAGTCTCATTTAAAACTCAA

GGAGAGTCTTGATTTGAAAGAGAGTGCAGTGGAGAACTTGTCATGGAAAGCTCCATCAACATCTCTGGAAGATGGA

TCTCATATATATGGTAGGGAGAAAGATAGGGAGGCCATAATCAAGTTGTTGTCGGAGGATAACAGTGACGGTAGTG

AAGTGTCTGTGGTTCCTATTGTGGGCATGGGTGGGGTTGGAAAAACTACTTTGGCCCAATTGGTGTACAATGATGAG

AATTTGAAAGAGAAATTTGATTTTGATTTTAAGGCATGGGTTTGTGTTTCTCAAGAATTTGATGTTCTGAAGGTCACA

AAAACTATAATACAGGCGGTTACTGGAAATCCTTGTAAATTGAATGATCTGAATCTACTTCATCTTGAATTGATGGA

CAAGCTGAAAGATAAAAAATTCCTAATTGTTTTGGATGATGTTTGGACAGAGGATTATGTTGATTGGAGTCTTCTTAA

GAAACCATTTCAATGTGGGATTATTAGGAGAAGTAAAATTCTTCTAACAACCCGCAGTGAAAAGACAGCCTCCGTA

GTCCAAACGGTTCAAACCTATCATCTAAACCAATTGTCGAATGAAGATTGTTGGTCAGTGTTTGCGAACCATGCGTG

TCTTTCCTTGGAATCGAACGAGAACACAACACTAGAAAAAATTGGAAAGGAGATTGTTAAAAAGTGCGATGGACTG

CCTTTAGCAGCACAGTCCCTTGGAGGCATGTTGAGAAGAAAGCATGACATTGGGGATTGGTATAATATTCTGAATAG

TGACATTTGGGAACTTTCTGAAAGTGAGTGTAAAGTTATTCCAGCACTGAGACTTAGTTATCATTATCTCCCTCCACA

TTTAAAACGGTGCTTTGTTTATTGTTCGTTGTATCCCCAAGATTACGAATTTGATAAAAATGAATTAATCTTGTTGTG

GATGGCTGAAGATCTTTTGAAGAAACCAAGGAAAGGTAGGACTTTAGAAGAGGTTGGTCATGAGTATTTTGATGATT

TGGTTTCGAGATCATTTTTCCAACGTTCAAGTACAAATAGAAGTAGTTGGCCTTATGGTGAATGTTTTGTGATGCATG

ACCTCATGCATGATCTAGCCAAATCACTCGGTGGAGATTTTTATTTTAGATCAGAAGAACTTGGGAAAGAAACAAAG

ATCAATACTAAGACTCGTCATTTGTCATTACCAAATTCAATTCTTCAGTCTTGGACAACTTTGATGTTGTTGGTAGA

GCAAAATTTCTGAGAACTTTCTTGTCCATTATCAATTTTGAAGCTGCTCCATTCAACAACGAGGAGGCACAATGTAT

CATTGTGTCGAAGCTTATGTACTTGAGAGTTTTATCATTTTGTGACTTCCAAAGTTTGGATTCTTTGCCTGATTCAATA

GGTAAATTGATCCATCTGCGCTATTTAGATCTTTCTCATTCAAGTGTAGAAACACTGCCAAAGTCATTGTGTAATTTA

TACAATCTGCAAACTTTGAAGTTGTGTAGTTGCAGAAAGCTGACTAAGTTGCCTAGTGACATGTGCAATCTTGTTAA

-continued

CTTGCGTCATCTTGAGATACGTGAAACTCCTATAGAAGAGATGCCGAGAGGAATGAGTAAATTAAATCATCTACAAC

ATCTGGATTTCTTTGTTGTGGGCAAGCACAAAGAGAATGGGATCAAAGAATTGGGAGGACTTTCAAATCTTCGTGGT

CGACTTAAAATTAGGAACTTGGAGAATGTTTCCCAAAGTGATGAAGCGTCGGAGGCAAGGATGATGGATAAAAAAC

ACATTAATAGTTTATGGTTGGAATGGTCTAGATGTAATAACAACAGTACCAACTTCCAACTAGAAATAGATGTGCTT

TGCAAGTTACAGCCTCACTTTAACATTGAATCGTTGAGAATAAAAGGCTATAAAGGAACCAGATTTCCAGATTGGAT

GGGAAATTCTTCCTACTGCAATATGATGAGTCTAAAATTGCGTGATTGTGACAACTGTAGTATGCTTCCTTCACTTGG

ACAACTACCTTCTCTCAAGGTCCTTAAGATTGCACGATTGAATAGGCTGAAGACTATTGATGCAGGTTTTTACAAGA

ACGAAGATTGTCGTCTGGGACGCCCTTTCCCTCCCTTGAATCTCTGGCCATTCATCAAATGCCTTGTTGGGAGGTGT

GGAGTTCCTTCGATTCAGAAGCTTTTCCTGTGCTTGAAATTCTTGAAATACGTGACTGCCCCAAACTAGAGGGAAGT

TTGCCGAATCACCTTCCTGCTCTGAAAACACTTACAATTAGAAATTGTGAGCTGCTTGGCTCTTCTCTCCCAACGGCT

CCCGCCATTCAAAGTTTGGAGATACGTAAAAGCAATAAAGTAGCACTGCATGCGTTTCCTCTCTTGGTAGAAACTAT

AAAAGTAGAAGGAAGCCCAATGGTGGAGTCCATGATGGAGGCCATCACAAACATCCAACCAACTTGTCTCCGGTCT

TTAACATTAAGGGATTGCTCGTCAGCCGTGTCATTTCCGGGTGGTCGTTTACCTGAATCACTGAAGAGTCTGTATATC

TCGGATCTTAAAAAACTGGAATTCCCGACGCAACACAAACATGAGTTACTGGAAACACTGTCAATAGAAAGCAGTT

GTGATTCACTCACATCTCTTCCATTGGTTACCTTTCCAAATCTCAGAGATCTTGAAATCAGAAACTGTGAAAATATGG

AATCTCTTTTGGTATCATTCTGGAGAGAAGGATTGCCTGCGCCCAACTTGATTACTTTCCAAGTGTGGGGCTCTGACA

AGTTGAAGTCGTTGCCTGATGAGATGAGTACTCTTCTCCCAAAGTTAGAACGTCTCCTCATATCCAACTGCCCAGAA

ATTGAGTCGTTTCCAAAACGGGGTATGCCACCTAACCTGAGAATAGTTTGGATTTTCAATTGTGAGAAACTACTGAG

CAGCCTAGCATGGCCATCCATGGGCATGCTTACTCATCTCTATGTTGGGGGTCGATGTGATGGCATCAAGTCCTTCC

CTAAGGAGGGTTTGCTGCCTCCCTCCCTTACGTATCTGTATCTAAGTGGATTCTCAAATCTGGAGATGTTGGACTGCA

CGGGGCTTCTCCATCTCACATCCCTGCAACAATTAACCATAGACGGATGTCCTTTGCTGGAAAATATGGTGGGAGAA

AGGCTTCCTGACTCTCTAATAAAATTAACCATAAAGAGTTGTCCTTTGCTGAAAAAACGATGCCGGAAGAAGCACCC

TCAAATTTGGCCTAAAATTTCCCACATCCCTGGCATTAAGGTTGACAATAGATGGATTTAG

>Rpsl-k-1_3'END (SEQ ID NO: 160)
CCACCAAGGAGGACCAACAGGTATCTTCTAAGTCTAACCAACTAGAAAACTAGTTCTGTCAAGGATATGTTTCATTT

CATGTCTTTCTCCTTTTACGTTTTACTAAATCCAATTCATTCTGAAATGGAAATTGACCTTGTATATATGTTACTGAAT

CTACAGAGAATCAACAAATCATCAAAGGCAACGTGGAAATTGACCTTGTATATATGTTTCGAAGAAGTAACGATAC

AGGTACTAAGTAACAACATTGATAAATACTTAAATATAATGATTCTCCGGAAAAAATGTTACACATCAGTATTGTTAT

ATTCTAACTTAATTTCTCCTTAAGATTATTGAGGCCAGAGTGAAAATGACCGTGGGAAACTTATTTTTGTTTTTCAGA

TATGGTTGATTGGCCCGGAGAAACTGTACCTACCCATGAATCTAAGTTCAAATTTGAACTAGTGCTAAATGTAACTT

TTAATTTAATTGACGTCAAATTGACACTTTCTCAATAGCTAAATTTTTATTTGTGAGGTTTTTTGTTAGGTACAATGTG

AAGGATGAAAAGGTGTACCAAGTGAACTTTAGAAGGATTGGATGATTTCAGCTTATCTCTTATCTCCTGTCCTATAA

ATTAATAGTGGTATGATTATTCTAAAAATATGATAGATATGTAGATACGTAAGAATTGATAAAAGCATAATAAATAT

ACAATTGCAATTCGGTAAATTGAAGAACATACATACTTCTTAGACATTGCTAAAAACAAAATCAAAAAATTGTAGAT

CATTTTTTCCTATTGTTCACAAATAAGAATGGTACTATCAATGATCAATCTCATTTCTTTCTTGAAATTATCTATAAAC

AAAACAATTTTCATATTTGGTCATCAAGAAACAATACTTTTTATATTTCTATATTATATTTACTTCTATGTTACATGT

CACTATATTTGATTATCATAATTTTTTTTTAAAAGAATTGGTCACTTTACATATATGTACCAGTGAAATATATCAATAT

ATTGGTATCGGATATAGATGCATGAAGCAAATTAAAGTATCAGTACTTTGTAGCAAAACACATTCTTCAAATCATGA

CATGAGGTAAAAAAATATGATGATATTTTTGTAAGTATTGGAAAAAAAAAAAAAAGTAAAGCTTCTGAAATCAAAG

AGACACTAATTTTCCACAACATCCTTCAATTGGGCCCAAGCTTCCTTTCCTATTGACAAATAACTGGTTGTTAGTGCC

-continued
AGCTTTTTCTTTTTTCTAGTTTTCCATTGATGGTTAAAAGCTAATATGAACCTGTCACTTCCTTAAAATTTCCACCAAAG

TTTGGTAAATAAATATATAGGAGAGTGAATAATGCAAGCCTTGCATTCTATCTCTAAGTTACTAGGTATATGAAACA

GGTATGGGTATGGTTTTAGAAGGTATGTGGTTCATCACTATTTATATTTTTACTACAAGAACCAGGTAAACTTTATTA

TGGTACAGTAAATTTAGTGTGAGGTTGTAACTACGTTATATCCATCTAACTTAGCACGATAATTAAATTTAAAAGCA

AAAAGATAAGAAAAAGGCCAATCTAACAATTGTTACCTCTCTTGCATGAAAAAATCAGAAACAAAAGCCCCACTCT

TTCCTCCATGGTGCCTGTAATTAACAAGCACTTCAAAAATCAATGTTAATTAATTAATTTCCATAAGAAAAAAAAGA

CAGAAGCTAATGAAATTTAAGGGGTACAACAAAGATTTGTAGAACGATCATTAATATTAGTGCAACACATCATGATG

AAGTGCATGACATAATAATAATGTGAAACCAATCATGATAAGAACAGAAAATAAATCAGTGCAATTACATGATTAG

AAAATAAAGAGGCGATATATCATATTCCTATTGATCAGACAATATGACAACGTGTTAAACAAATGTGTCAGGTGCAA

TAATGAGGGGATAGAGAAGAGAAGGATGATAAAGAATGTGGTTATGACTTCTACAAAGTCGAATTATTTACTTTTTT

AATTTTTTATATTTTCCTTTTCACTTTTCTAATAGTTGTCCGATTAAGAGGAGTTTATAGAGTAGATTAAATTGGTTTT

GAAAAAGAGAAATATCATCTTATACAATTTTTGGTTTTCTTAATTCATTGTTCAATTGATGTAGTTTAAAATTTAAAT

ATGATTTAATAAGTTTGGATTGATCTCGA

Rpsl-k-2
>Rpsl-k-2_5'END (SEQ ID NO: 161)
TTTACATAACTTTTGGATTTAACAAAAAAATTCATTTTCAATTTTACTATTAACTTATTTTTTAAATAAAAATATCCAA

AACACATGTGCAAACTGCTTCAATACAACTTGTCTCACAGCATCAAAGCACAGGAACATAATTATGCACAGTACCCT

TGCAGCCATCCACACATATCACCAAGAAAAAAACACACACCACTGCTCCACACGGTTTGGAAAGCGAGAAAGCTGG

CCATCACTAACTTTAATTATAGCATTTTAGAAATATAATCCATTTTTTTAAAATTAACGGTAGAAATATCATCACTCT

TTAAATCTCTGAGTCTTTAGTTTAGAGGAGCTAAATTTAAAATAGAAATATCAAGAAAGCAACATGTGGGGATCAA

AAGTAAAGAGACTCCCAACGTGATAAGTCACCCACCACCAATTCCCTTGCCTTTTGTCTTGCACAGCAGAACGAGTG

AAGGTGAAGAGAGTTGACTTAAGCCAAATCTCATCACATCAGTTCATAGCAACCAATTCCCTTGCCTTTGTCTTTCTA

CTCTGATCATCTTTTGTTCTTGAGATA

>Rpsl-k-2_ORF (SEQ ID NO: 162)
ATGGCAGCAGCACTGGTCGGTGGTGCCTTCCTCTCTGCTTTTCTTGATGTGGTTTTCGACAGGCTGGCTTCACCTGAG

TTTGTTGACTTGATCCGTGGAAAGAAGCTTAGCAAGAAGTTGCTTCAAAAGTTGGAGACCACTCTCAGAGTGGTTGG

AGCTGTGCTTGATGATGCCGAGAAGAAACAGATCACAAACACCAATGTCAAACACTGGCTCAATGATCTCAAACAT

GCTGTCTATGAAGCCGATGACTTACTCGACCATGTTTTCACCAAAGCTGCCACCCAAAACAAGGTAAGAGACTTGTT

TTCTCGCTTTTCCGATAGGAAGATCGTTAGTAAGTTGGAGGACATAGTTGTCACACTTGAGTCTCATTTAAAACTCAA

GGAGAGTCTTGATTTGAAAGAGAGTGCAGTGGAGAACTTGTCATGGAAAGCTCCATCAACATCTCTGGAAGATGGA

TCTCATATATATGGTAGGGAGAAAGATAAGGAGGCCATAATCAAGTTGTTGTCGGAGGATAACAGTGACGGTAGAG

AAGTGTCTGTGGTTCCTATTGTGGGCATGGGTGGGGTTGGAAAAACTACTTTGGCCCAATTGGTGTACAACGATGAG

AATTTGAAACAGATATTTGATTTTGATTTTAAGGCATGGGTTTGTGTTTCTCAAGAATTTGATGTTCTCAAGGTCACA

AAAACTATAATAGAGGCGGTGACTGGAAAGGCTTGTAAATTGAATGATCTGAATCTACTTCATCTTGAATTGATGGA

CAAGCTGAAAGATAAAAAATTCTTAATTGTTTTGGATGATGTTTGGACAGAGGATTATGTTGATTGGCGTCTTCTTAA

GAAACCATTTAACCGTGGGATTATTAGGAGAAGTAAAATTCTTCTAACAACCCGCAGTGAAAAAACAGCATCTGTA

GTCCAAACTGTTCACACCTATCATCTAAACCAATTGTCGAATGAAGATTGTTGGTCAGTGTTTGCGAACCATGCATG

TCTTTCCACGGAATCTAACGAGAACACAGCAACACTAGAAAAAATTGGAAAGGAGATTGTTAAAAAGTGCAACGGA

CTGCCTTTAGCAGCAGAGTCGCTTGGAGGCATGTTGAGAAGAAAGCATGACATTGGTGATTGGAATAATATTCTCAA

TAGTGACATTGGGAACTTTCTGAAAGTGAGTGTAAAGTATTCCAGCACTGAGACTTAGTTATCATTATCTCCCTCC

ACATTAAAACGATGCTTTGTTATTGTTCGTTGTATCCACAAGATTACGAATTTGAAAAAAATGAATTAATCTTGTT

GTGGATGGCTGAAGATCTTTTGAAGAAACCAAGGAAAGGTAGGACTTTAGAAGAGGTTGGTCATGAGTATTTTGATG

-continued

ATTTGGTTTCGAGATCGTTTCCAACGTTCAAGAACAAGTAGTTGGCCTCATCGCAAATGTTTTGTGATGCATGACC

TCATGCATGATCTAGCCACATCACTCGGTGGAGATTTTTATTTTAGATCAGAAGAACTTGGGAAAGAAACAAAGATC

AATACCAAGACTCGTCATTTGTCATTTGCCAAATTCAATTCTTCAGTCTTGGACAACTTTGATGTTATTGGTAGAGCA

AAATTTCTGAGAACCTTCTTGTCCATTATCAATTTTGAAGCTGCTCCATTCAACAATGAGGAGGCACAATGTATCATA

ATGTCGAAGCTTATGTACTTGAGAGTTTTATCATTTTGTGACTTCCAAAGTCTGGATTCTTTGCCTGATTCAATAGGT

AAATTGATCCATCTGCGCTATTTAGATCTCTCTTTTTCAAGAATAGAAACACTGCCAAAGTCATTGTGTAATTTGTAC

AATCTGCAAACTTTGAAGTTGTGTAGTTGCAGAAAGCTGACTAAGTTGCCCAGTGACATGCGCAATCTTGTTAACTT

GCGTCATCTTGGTATTGCTTATACTCCTATAAAAGAGATGCCGAGAGGAATGGGTAAATTAAATCATTTACAACATC

TGGATTTCTTTGTTGTGGGCAAGCACGAAGAGAATGGAATCAAAGAATTGGGAGGACTTTCAAATCTTCGTGGTCAG

CTTGAAATTAGGAAGTTGGAGAATGTTTCCCAAAGTGATGAAGCGTTGGAGGCAAGGATGATGGATAAAAAACACA

TTAATAGTACAGTTGGAATGGTCTGGATGTAACAACAACAGTACCAACTTCCAACTTGAAATAGATGTGCTTTGC

AAGTTACAGCCTCACTTTAACATTGAATCGTTGGAAATAAAAGGTTATGAAGGAACCAGATTTCCAGATTGGATGGG

AAATTCTTCCTACTGCAATATGATTAGTCTAAAATTGCGTGATTGTCACAACTGTAGTATGCTTCCTTCACTTGGACA

ACTACCTTCTCTCAAGGACCTTGGAATTGCACGATTGAATAGGCTGAAGACTATTGATGCAGGTTTCTACAAGAATG

AAGAATGTCGTTCTGGGACGTCCTTTCCCTCCCTTGAATCTCTGTCCATTGATGACATGCCTTGTTGGGAGGTGTGGA

GTTCCTTCGATTCAGAAGCTTTTCCTGTGCTTAACAGTCTTGAAATACGTGACTGCCCCAAACTAGAGGGAAGTTTGC

CGAATCACCTTCCTGCTCTGACAAAACTTGTGATTAGAAATTGCGAGCTGCTTGTCTCTTCTCTCCCAACGGCTCCCG

CCATTCAAAGTTTGGAGATATGTAAAAGCAATAAAGTAGCACTGCATGCGTTTCCTCTCTTGGTAGAAACTATAGAA

GTAGAAGGAAGCCCAATGGTGGAGTCCGTGATCGAGGCCATCACTAACATCCAACCAACTTGTCTCCGGTCTTTAAC

ATTAAGGGATTGTTCGTCAGCCGTGTCATTTCCGGGTGGTCGTTTACCTGAATCACTGAAGAGTCTGAGTATCAAGG

ATCTTAAAAAACTGGAATTCCCGACGCAACACAAACATGAGTTACTGGAAACACTGTCAATAGAAAGCAGTTGTGA

TTCACTCACATCTCTTCCATTGGTTACCTTTCCAAATCTCAGATATCTCAGCATCGAAAAGTGTGAAAATATGGAATA

TCTTTTGGTTTCAGGGGCAGAGTCATTTAAGAGTCTGTGTTATTTGTTAATTTACAAATGCCCCAACTTTGTATCATTC

TGGAGAGAAGGATTGCCTGCGCCCAACTTGATTACTTTCAGTGTTTGGGGCTCTGACAAGTTGAAGTCGTTGCCTGA

TGAGATGAGTACTCTTCTCCCAAAGTTAGAAGATCTCACCATATCCAACTGCCCAGAAATTGAGTCCTTTCCAAAAC

GGGGTATGCCACCTAACCTGAGAAGAGTTGAGATTGTCAATTGTGAGAAACTACTGAGCGGCCTAGCATGGCCATC

CATGGGCATGCTTACTCATCTCAATGTTGGGGGTCCATGTGATGGCATCAAGTCCTTCCCTAAAGAGGGTTTGCTGC

CTCCCTCCCTTACGTCTCTGTCTCTATATGACTTGTCAAATCTGGAGATGTTGGACTGCACGGGGCTTCTCCATCTCA

CATCCCTGCAACAATTACAAATTTTTGGATGTCCAAAGCTGGAGAATATGGCTGGAGAAAGTCTTCCTTTCTCTCTA

ATAAAATTAACCATGGTGGAATGTCCTTTGCTGGAAAAACGATGCCGCATGAAGCACCCTCAAATTTGGCCTAAAGT

TTCCCACATCCCTGGCATTAAGGTTGGCAATAGATGGATTTAG

>Rpsl-k-2_3'END (SEQ ID NO: 163)
CCACCAAGGAGGACCAACAGGTATCTTCTAAGTCTAACCAACTAGAAAACTATTTCTGTCAAGGATATGTTTCATTT

CATGTCTTTCTACTTTTACGTTTTACTAAATCCAATTCATTCTGAAATGGAAATTGACCTTGTATATATGTTACTGAAT

CTACAGAGAATCAACAAATCATCAAAGGCAACGTGGAAATTGACCTTGTATATATGTTTCGAAGAAGTAACGATAC

AGGTACTAAGTAACAACATTGACAAATACTTAAATATAATGATTCTCCGGAAAAAATGTTACACATCAGTGTTGTTAT

ATTCTAACTTAATTTCTCCTTAAGATTATTGAGGCCAGAGTGAAAATGACCGTGGGAAACTTATTTTTGTTTTTCAGA

TATGGTTGATTGGCCCGGAGAAACTGTACCTACCCATGAATCTAAGTTCAAATTTGAACTAGTGCTAAATGTAACTT

TTAATTTAATTGATGTCAAATTGACACTTTCTCAATAGCTGAATTTTTATTTGTGAGGTTTTTCGTTGGGTACAATGTG

AAGGATGAAAAGGTGTACCAAGTGAACTTTAGAAGGATTGGATGATTTCAGCTTATCTCTTATTCCCTGTCCTATAA

-continued
AATAATGGTATGATTTATTCTAAAAATATGATAGATATGTAGATAAGTAAGAATTGATAAAAGCATAATAAATAT

ACAATTGCAATTCGGTAAACTGAAGAACATACATACTTCTTAGACATTGCTAAAAACAAAATCAAAAAATTGTAGAT

CATTTTTTTCCTATTGTTCACAAATAAGAATGGTACTATCAATGATCAATCTCATTTCTTTCTTGAAATTATCTATAAA

CAAAACAATTTTCATATTGGTTCATCAAGAAACAATACTTTTTATATTTCTATATTATACTTACTTCTATGTTACATGT

CACTATATTTGATTATCATAATTTTTTTTAAAGAATTGGTCACTTCACATATATGTATCAGATATATTGGTATCAGAT

ATAGATGCATGAAGCAAATTAAAGTATCAGTACTTTGTAGCAAAACACATTCTTCAAATCATGACATGAGGTAAAAA

AAAATAAGATGATATTTTTGTAAGTATTGGAAAAAAAAAGAGTAAAGCTTCTGAAATCAAAGAGACACTAATTTTCC

ACAACATCCTTCAATTGGGCCCAAGCTTCCTTTCCTATGGACAAATAACTGGTTGTTAGTGCCAGCCTTTTCTTTTTA

CCAGTTTTCCATTGATGGTTAAAAGCTATTATGAACCTGTCACTCCTTAAAATTTCCACCAAAGTTTGGTAAATAAAT

ATATAGGAGAGTGAATAATACAAGTCTTGCATTCTATCTCTAAGTTATTAGGTATATGAAACAGGTATGGGTATTTG

GTTTTAGAAGGTATGTGGTTCATCACTATTTATATTATTACTACAAGAACCAGGTAAACTTTATTATGGTACAGTAAG

TTTGGTGTGAGTTGTAACTACGTTATATCCATCTCACTTAGCACGATAATTAAATTTAAAAGCAAAAAGATAAGAAA

AAGGCCAATCTAACAATTGTTACCTCTCTTGCATGACAAAATCAGAAACAAAAGTCCCACTCTTTCCTCCATGGTGC

CTGTAATTAACAAGCACTTCAAAAACCAATGTTAATTAATTTAATTTCCATAAAAAAAAAAAGGCAAAAGCCAATGA

AATTTAAGGGGTACAACAAAGATTTGTAGAACGATCATTAATATTAGTGCAACGCACCATGATGAAGTGCATGACAT

AATAATAATGTGGAACCAATCATGATAAGAACAGAAAATAAATCAATGCAATTGCATGATCAGAAAATAACGAGGC

GATATATCATGTTCCTATTGATAGACAATAGGACAACGTGTTAAAGAAATGTGTCAAGTGCAACAATGAGGGAACG

GAGAAGAGAAGGATGATAAAGAATGTGGTTATGACTTCTACAAAGTCCAATTATTTACTTTTTTAATTTTTTATATTT

TCCTTTTCACTTTCCTAATAGTTGTCGGATTAAAAGGAGTTTATGGAGTAGATTAGATTGGTTTTGAAAAAGAGAAAT

ATCATCTGATACAATTTTTAGTTTTCTTAATTTATTGTTCAATTGATGTAGTTTAAAAAGTTGCACTAACTGAAGTGGA

AAAGGAACATAGGTTGGCATAATGGAAT

Rpsl-k-3
>Rpsl-k-3_5'END (SEQ ID NO: 164)
ACTTCTCTCTGCAAGCTAAAAAGGAGTGTTGTTTAGGAAACAATTTTGAGGCAGGTGTATTTTGGAAAAAATGAGGA

GAGAGCAAGTGTAGTGGAGTAAAAAAATCCTGTAAGGTTTTGTTTGGTAGTAAAAAGAAAAAAATAATTGTAATGA

GAAAAAATAAGTTAGAGGATAAATATCTTCAACACTTAAACAAACAAATAAAAAAGTTTTTCTAGGAAGTTCACTTA

AATCTATTAACTATTGATAAAAATTTATACCTGTTGATTTAAAATAAAATTATATTTATTAAATATGATAGGAGAA

AAAATATTTTTTACATATAGTAAAATATTTTCATTTGCTGAACTTAAATTTTCTTTATCTCTCATTTTACTATTGTTGTT

TGAGATGATCTCACTGAATATATTAATAATAAAATTTTTATATAAATAAGATTCAAAGGATAATCACCAACCAAGAA

ATTTATGGAAGTATTTATCAAATAATTACAATAGATATATAACATAAAAAAAAGAGTTGAATTGAATAATAATTTTT

CATGCCATCATTTCAAAAGAATTACTTTAATCACTCTCTTTATATTATTATTATTATTATTATAACATCTTCACAATAT

TTTTTATTTTATTAGTATTTATTGATTTTATTTAATAAAAAATCACACACTTTTCTTTTTGCACACATCTTTAATCTACA

TATAAGGATATTCAAATCTTGACTTCATTAATATATATTATTGTTTTTAGGGATCAATTAGCATGTGTCTTTTCTTTAA

TTCTTTCTCTTTTAATTTGTTCAACATTTTTATTGTGTTAATAATTTTTTAATCTCATTTTTTTATTTTCCTCCTAACAAA

ATTTATTCTATATATAAGAATTAATAAAGATTTAAATCTTTTACCACTTGATTAAAAAACATAAATTACTATCAATTA

TTTTAACTTTTTATAAAATCATGATTCAGATCTTTATACAATAACATATCTCATCATGTGTTAGTTGTTTATATCATCA

CTCTTTAAATCTCTTGAGTCTTTAGTTTAGAGGAGCTAAATTCAAAATAGAAATATCAAGAAAGTAACATATGTGAG

GATCAAAAGTAAAGAGACTCCCAACGTGATAAGTCACCCACCACCATAATAATACAAATAATAAAAATAAAAAAGA

CCATACTTTTGTCTTGCACAGCAGAACGAGTGAAGGTGAAGAGAGTTGACTTAAGCCAAATCTCATCACATCAGTTC

ATAGCAACCAATTCCCTTGCCTTTGTCTTTCTACTCTGATCATCTTTTGTTCTTGAGATA

-continued

>Rpsl-k-3_ORF (SEQ ID NO: 165)
ATGGCTGCAGCACTGGTCGGTGGTGCCTTTCTCTCTGCTTTCCTTGATGTGCTTTTCGACAGGCTGGCTTCACCTGAC
TTTGTTGACTTGATCCTTGGAAAGAAGCTTAGCAAGAAGTTGCTTCGAAAGTTGGAGACCACTCTCAGAGTGGTTGG
AGCTGTGCTTGATGATGCCGAGAAGAAACAGATCACAAACACCAATGTCAAACACTGGCTCAATGCTCTCAAAGAT
GCTGTCTATGAAGCCGATGACTTACTCGACCATGTTTTCACCAAAGCTGCCACCCAAAACAAGGTAAGAAACTTGTT
TTCTCGCTTTTCCGATCGGAAGATCGTTAGTAAGTTGGAGGACATAGTTGTCACCCTAGAGTCTCATTTAAAACTCAA
GGAGAGTCTTGATTTGAAAGAGAGTGCAGTGGAGAACTTGTCATGGAAAGCTCCATCAACATCTCTGGAAGATGGA
TCTCATATATATGGTAGGGAGAAAGATAGGGAGGCCATAATCAAGTTGTTGTCGGAGGATAACAGTGACGGTAGTG
AAGTGTCTGTGGTTCCTATTGTGGGCATGGGTGGGGTTGGAAAAACTACTTTGGCCCAATTTGGTGTACAATGATGAG
AATTTGAAAGAGAAATTTGATTTTGATTTTAAGGCATGGGTTTGTGTTTCTCAAGAATTTGATGTTCTGAAGGTCACA
AAAACTATAATACAGGCGGTTACTGGAAATCCTTGTAAATTGAATGATCTGAATCTACTTCATCTTGAATTGATGGA
CAAGCTGAAAGATAAAAAATTCCTAATTGTTTTGGATGATGTTTGGACAGAGGATTATGTTGATTGGAGTCTTCTTAA
GAAACCATTTCAATGTGGGATTATTAGGAGAAGTAAAATTCTTCTAACAACCCGCAGTGAAAAGACAGCCTCCGTA
GTCCAAACGGTTCAAACCTATCATCTAAACCAATTGTCGAATGAAGATTGTTGGTCAGTGTTTGCGAACCATGCGTG
TCTTTCCTTGGAATCGAACGAGAACACAACACTAGAAAAAATTGGAAAGGAGATTGTTAAAAAGTGCGATGGACTG
CCTTTAGCAGCACAGTCCCTTGGAGGCATGTTGAGAAGAAAGCATGACATTGGGGATTGGTATAATATTCTGAATAG
TGACATTTGGGAACTTTCTGAAAGTGAGTGTAAAGTTATTCCAGCACTGAGACTTAGTTATCATTATCTCCCTCCACA
TTTAAAACGGTGCTGTTTATTGTTCGTTGTATCCCCAAGATTACGAATTTGATAAAAATGAATTTAATCTTGTTGTG
GATGGCTGAAGATCTTTTGAAGAAACCAAGGAAAGGTAGGACTTTAGAAGAGGTTGGTCATGAGTATTTTGATGATT
TGGTTTCGAGATCATTTTTCCAACGTTCAAGTACAAATAGAAGTAGTTGGCCTTATGGTGAATGTTTTGTGATGCATG
ACCTCATGCATGATCTAGCCAAATCACTCGGTGGAGATTTTTTATTTTAGATCAGAAGAACTTGGGAAAGAAACAAAG
ATCAATACTAAGACTCGTCATTTGTCATTTACCAAATTCAATTCTTCAGTCTTGGACAACTTTGATGTTGTTGGTAGA
GCAAAATTTCTGAGAACTTTCTTGTCCATTATCAATTTTGAAGCTGCTCCATTCAACAACGAGGAGGCACAATGTAT
CATTGTGTCGAAGCTTATGTACTTGAGAGTTTTATCATTTTGTGACTTCCAAAGTTTGGATTCTTTGCCTGATTCAATA
GGTAAATTGATCCATCTGCGCTATTTAGATCTTTCTCATTCAAGTGTAGAAACACTGCCAAAGTCATTGTGTAATTTA
TACAATCTGCAAACTTTGAAGTTGTGTAGTTGCAGAAAGCTGACTAAGTTGCCTAGTGACATGTGCAATCTTGTTAA
CTTGCGTCATCTTGAGATACGTGAAACTCCTATAGAAGAGATGCCGAGAGGAATGAGTAAATTAAATCATCTACAAC
ATCTGGATTTCTTTGTTGTGGGCAAGCACAAAGAGAATGGGATCAAAGAATTGGGAGGACTTTCAAATCTTCGTGGT
CGACTTAAAATTAGGAACTTGGAGAATGTTTCCCAAAGTGATGAAGCGTCGGAGGCAAGGATGATGGATAAAAAAC
ACATAATAGTTTATGGTTGGAATGGTCTAGATGTAATAACAACAGTACCAACTTCCAACTAGAAATAGATGTGCTT
TGCAAGTTACAGCCTCACTTTAACATTGAATCGTTGAGAATAAAAGGCTATAAAGGAACCAGATTTCCAGATTGGAT
GGGAAATTCTTCCTACTGCAATATGATGAGTCTAAAATTGCGTGATTGTGACAACTGTAGTATGCTTCCTTCACTTGG
ACAACTACCTTCTCTCAAGGTCCTTAAGATTGCACGATTGAATAGGCTGAAGACTATTGATGCAGGTTTTTACAAGA
ACGAAGATTGTCGTTCTGGGACGCCCTTTCCCTCCCTTGAATCTCTGGCCATTCATCAAATGCCTTGTTGGGAGGTGT
GGAGTTCCTTCGATTCAGAAGCTTTTCCTGTGCTTGAAATTCTTGAAATACGTGACTGCCCCAAACTAGAGGGAAGT
TTGCCGAATCACCTTCCTGCTCTGAAAACACTTACAATTAGAAATTGTGAGCTGCTTGGCTCTTCTCTCCCAACGGCT
CCCGCCATTCAAAGTTTGGAGATACGTAAAAGCAATAAAGTAGCACTGCATGCGTTTCCTCTCTTGGTAGAAACTAT
AAAAGTAGAAGGAAGCCCAATGGTGGAGTCCATGATGGAGGCCATCACAAACATCCAACCAACTTGTCTCCGGTCT
TTAACATTAAGGGATTGCTCGTCAGCCGTGTCATTTCCGGGTGGTCGTTTACCTGAATCACTGAAGAGTCTGTATATC
TCGGATCTTAAAAAACTGGAATTCCCGACGCAACACAAACATGAGTTACTGGAAACACTGTCAATAGAAAGCAGTT -continued

GTGATCACTCACATCTCTTCCATTGGTTACCTTTCCAAATCTCAGAGATCTTGAAATCAGAAACTGTGAAAATATGG

AATCTCTTTTGGTATCATTCTGGAGAGAAGGATTGCCTGCGCCCAACTTGATTACTTTCCAAGTGTGGGGCTCTGACA

AGTTGAAGTCGTTGCCTGATGAGATGAGTACTCTTCTCCCAAAGTTAGAACGTCTCCTCATATCCAACTGCCCAGAA

ATTGAGTCGTTTCCAAAACGGGGTATGCCACCTAACCTGAGAATAGTTTGGATTTTCAATTGTGAGAAACTACTGAG

CAGCCTAGCATGGCCATCCATGGGCATGCTTACTCATCTCTATGTTGGGGGTCGATGTGATGGCATCAAGTCCTTCC

CTAAGGAGGGTTTGCTGCCTCCCTCCCTTACGTATCTGTATCTAAGTGGATTCTCAAATCTGGAGATGTTGGACTGCA

CGGGGCTTCTCCATCTCACATCCCTGCAACAATTAACCATAGACGGATGTCCTTTGCTGGAAAATATGGTGGGAGAA

AGGCTTCCTGACTCTCTAATAAAATTAACCATAAAGAGTTGTCCTTTGCTGAAAAAACGATGCCGGAAGAAGCACCC

TCAAATTTGGCCTAAAATTTCCCACATCCCTGGCATTAAGGTTGACAATAGATGGATTTAG

>Rpsl-k-3_3'END (SEQ ID NO: 166)
CCACCAAGGAGGACCAACAGGTATCTTCTAAGTCTAACCAACTAGAAAACTAGTTCTGTCAAGGATATGTTTCATTT

CATGTCTTTCTCCTTTTACGTTTTACTAAATCCAATTCATTCTGAAATGGAAATTGACCTTGTATATATGTTACTGAAT

CTACAGAGAATCAACAAATCATCAAAGGCAACGTGGAAATTGACCTTGTATATATGTTTCGAAGAAGTAACGATAC

AGGTACTAAGTAACAACATTGATAAATACTTAAATATAATGATTCTCCGGAAAAATGTTACACATCAGTATTGTTAT

ATTCTAACTTAATTTCTCCTTAAGATTATTGAGGCCAGAGTGAAAATGACCGTGGGAAACTTATTTTTGTTTTTCAGA

TATGGTTGATTGGCCCGGAGAAACTGTACCTACCCATGAATCTAAGTTCAAATTTGAACTAGTGCTAAATGTAACTT

TTAATTAATTGATGTCAAATTGACACTTTCTCAATAGCTGAATTTTTATTTGTGAGGTTTTTCGTTGGGTACAATGTG

AAGGATGAAAAGGTGTACCAAGTGAACTTTAGAAGGATTGGATGATTTCAGCTTATCTCTTATTCCCTGTCCTATAA

ATTAATAATGGTATGATTATTCTAAAAATATGATAGATATGTAGATAAGTAAGAATTGATAAAAGCATAATAAATAT

ACAATTGCAATTCGGTAAACTGAAGAACATACATACTTCTTAGACATTGCTAAAAACAAAATCAAAAAATTGTAGAT

CATTTTTTCCTATTGTTCACAAATAAGAATGGTACTATCAATGATCAATCTCATTTCTTTCTTGAAATTATCTATAAA

CAAAACAATTTTCATATTGGTTCATCAAGAAACAATACTTTTTATATTTCTATATTATACTTACTTCTATGTTACATGT

CACTATATTTGATTATCATAATTTTTTTTAAAGAATTGGTCACTTCACATATATGTATCAGATATATTGGTATCAGAT

ATAGATGCATGAAGCAAATTAAAGTATCAGTACTTTGTAGCAAAACACATTCTTCAAATCATGACATGAGGTAAAAA

AAAATAAGATGATATTTTTGTAAGTATTGGAAAAAAAAAGAGTAAAGCTTCTGAAATCAAAGAGACACTAATTTTCC

ACAACATCCTTCAATTGGGCCCAAGCTTCCTTTTCCTATGGACAAATAACTGGTTGTTAGTGCCAGCCTTTTCTTTTTA

CCAGTTTTCCATTGATGGTTAAAAGCTATTATGAACCTGTCACTCCTTAAAATTTCCACCAAAGTTTGGTAAATAAAT

ATATAGGAGAGTGAATAATACAAGTCTTGCATTCTATCTCTAAGTTATTAGGTATATGAAACAGGTATGGGTATTTG

GTTTTAGAAGGTATGTGGTTCATCACTATTTATATTATTACTACAAGAACCAGGTAAACTTTATTATGGTACAGTAAG

TTTGGTGTGAGTTGTAACTACGTTATATCCATCTCACTTAGCACGATAATTAAATTTAAAAGCAAAAAGATAAGAAA

AAGGCCAATCTAACAATTGTTACCTCTCTTGCATGACAAAATCAGAAACAAAAGTCCCACTCTTTCCTCCATGGTGC

CTGTAATTAACAAGCACTTCAAAAACCAATGTTAATTAATTAATTTCCATAAAAAAAAAAAGGCAAAAGCCAATGA

AATTTAAGGGGTACAACAAAGATTTGTAGAACGATCATTAATATTAGTGCAACGCACCATGATGAAGTGCATGACAT

AATAATAATGTGGAACCAATCATGATAAGAACAGAAAATAAATCAATGCAATTGCATGATCAGAAAATAACGAGGC

GATATATCATGTTTCCTATTTGATCAGACAATAGGACAACGTGTTAAAGAAATGTGTCAAGTGCAACAATGAGGGAAC

GGAGAAGAGAAGGATGATAAAGAATGTGGTTATGACTTCTACAAAGTCCAATTATTTACTTTTTTAATTTTTTATATT

TTCCTTTTCACTTTCCTAATAGTTGTCGGATTAAAAGGAGTTTATGGAGTAGATTAGATTGGTTTTGAAAAAGAGAAA

TATCATCTGATACAATTTTAGTTTTCTTAATTTATTGTTCAATTGATGTAG

Rpsl-k-4
>Rpsl-k-4_5'END (SEQ ID NO: 167)
ACTTCTCTCTGCAAGCTAAAAAGGAGTGTTGTTTAGGAAACAATTTTGAGGCAGGTGTATTTTGAAAAAAATTGAGG

AGAGAGCAAGTGTAGTGGAGTAAAAAAATCCTATAAGATTTTGTTTGATACTAAAAAGAAAAAAATAATTGTGATG

-continued

AGAAAAAATAAGTTAGAGGATAAATATCTTCAACACTTAAACAAACAAATAAAAAAGTTTTTCTAGAAAGTTCACTT

AAATCTATTTCACTATTGATAAAAATTTATACCTGTTGATTTAAAATAAAATTATATTTTATAAAAATTATATTTATT

AAATATGATAGGAGAAAAATATTTTTTACATATAGTAAAATATTTTCATTTGCTGGACTTAAATTTTCTTTATCTCTCA

TTTTAGTATTGTTGTTTGAGATGATCTCACTAAATATATTTTACTTGACTAATAATAAAAATTTTATATAGATAAGATT

CAAAGGATAATCACCAACCAAAAATTTTTATGGAAGTATTTATCAAATAATTACAATAGATATATAACATAAAAAAA

GAGTTGAATTGAATAATAATTTTTCATGCCAAATTACTTTAATCACTCTATATTATTATTATTATTATCATTATTATAA

CATCTTCACAATATTCTTATTTTATTAGTATCTATTATTTATTTTATTAATTTTATTTAATAAAAAATCACAAACTTTT

CTTTTTGCACACATCTTTAACGTACATATAAAGATATTCAAATCTTGAATTCATTAATATTATGTTTTTAGGGATCAAT

TAGCATGTGTCCTTTCTTTAATTCTTTCTCTTTTAATTTGTTCAACATTTTTTTTGTCTTAATAATTTTTTAATCTCATTT

TTTTATTTTCCTCCTAACAAAATTTATTCTATATATAAGAATTAATAAAAATTTAAATCTTTTACCACTTGATTAAAAA

ACATAAATCATTATCAATTATTTTAAATTTATAAAATCATGATTCAGTATTAGATCTTTATAAAATACCATATCTCTAT

GACAATTTTAATGATTAGGTTGAAATATAAACTAACACGAATTTAAGTAAATATTTCACTATTTACTTTCACATTGAA

AAATTGATTTTAAATTTTAACTTTAGAAAAAAAATTCTAAGTTGAGGATCTTTACATAACTTTTGGATTTAACAAAAA

AATTCATTTTCAATTTTACTATTAACTTATTTTTTAAATAAAAATATCCAAAACACATGTGCAAACTGCTTCAATACA

ACTTGTCTCACAGCATCAAAGCACAGGAACATAATTATGCACAGTACCCTTGCAGCCATCCACACATATCACCAAG

AAAAAAACACACACCACTGCTCCACACGGTTTGGAAAGCGAGAAAGCTGGCCATCACTAACTTTAATTATAGCATTT

TAGAAATATAATCCATTTTTTTAAAATTAACGGTAGAAATATCATCACTCTTTAAATCTCTTGAGTCTTTAGTTTAGA

GGAGCTAAATTTAAAATAGAAATATCAAGAAAGCAACATGTGGGGATCAAAAGTAAAGAGACTCCCAACGTGATAA

GTCACCCACCACCAATTCCCTTGCCTTTTGTCTTGCACAGCAGAACGAGTGAAGGTGAAGAGAGTTGACTTAAGCCA

AATCTCATCACATCAGTTCATAGCAACCAATTCCCTTGCCTTTGTCTCTACTCTGATCATCTTTTGTTCTTGAGATA

>Rps1-k-4_ORF (SEQ ID NO: 168)
ATGGCAGCAGCACTGGTCGGTGGTGCCTTCCTCTCTGCTTTTCTTGATGTGGTTTTCGACAGGCTGGCTTCACCTGAG

TTTGTTGACTTGATCCGTGGAAAGAAGCTTAGCAAGAAGTTGCTTCAAAAGTTGGAGACCACTCTCAGAGTGGTTGG

AGCTGTGCTTGATGATGCCGAGAAGAAACAGATCACAAACACCAATGTCAAACACTGGCTCAATGATCTCAAACAT

GCTGTCTATGAAGCCGATGACTTACTCGACCATGTTTTCACCAAAGCTGCCACCCAAAACAAGGTAAGAGACTTGTT

TTCTCGCTTTTCCGATAGGAAGATCGTTAGTAAGTTGGAGGACATAGTTGTCACACTTGAGTCTCATTTAAAACTCAA

GGAGAGTCTTGATTTGAAAGAGAGTGCAGTGGAGAACTTGTCATGGAAAGCTCCATCAACATCTCTGGAAGATGGA

TCTCATATATATGGTAGGGAGAAAGATAAGGAGGCCATAATCAAGTTGTTGTCGGAGGATAACAGTGACGGTAGAG

AAGTGTCTGTGGTTCCTATTGTGGGCATGGGTGGGGTTGGAAAAACTACTTTGGCCCAATTGGTGTACAACGATGAG

AATTTGAAACAGATATTTGATTTGATTTTAAGGCATGGGTTTGTCTTTTCTCAAGAATTTGATGTTCTCAAGGTCACA

AAAACTATAATAGAGGCGGTGACTGGAAAGGCTTGTAAATTGAATGATCTGAATCTACTTCATCTTGAATTGATGGA

CAAGCTGAAAGATAAAAAATTCTTAATTGTTTTGGATGATGTTTGGACAGAGGATTTATGTTGATTGGCGTCTTCTTAA

GAAACCATTTAACCGTGGGATTATTAGGAGAAGTAAAATTCTTCTAACAACCCGCAGTGAAAAAACAGCATCTGTA

GTCCAAACTGTTCACACCTATCATCTAAACCAATTGTCGAATGAAGATTGTTGGTCAGTGTTTGCGAACCATGCATG

TCTTTCCACGGAATCTAACGAGAACACAGCAACACTAGAAAAAATTGGAAAGGAGATTGTTAAAAAGTGCAACGGA

CTGCCTTTAGCAGCAGAGTCGCTTGGAGGCATGTTGAGAGAAAGCATGACATTGGTGATTGGAATAATATTCTCAA

TAGTGACATTGGGAACTTTCTGAAAGTGAGTGTAAAGTTATTCCAGCACTGAGACTTAGTTATCATTATCTCCCTCC

ACATTTAAAACGATGCTTTGTTTATTGTTCGTTGTATCCACAAGATTACGAATTTGAAAAAAATGAATTAATCTTGTT

GTGGATGGCTGAAGATCTTTTGAAGAAACCAAGGAAAGGTAGGACTTTAGAAGAGGTTGGTCATGAGTATTTTGATG

ATTTGGTTTCGAGATCGTTTTTCCAACGTTCAAGAACAAGTAGTTGGCCTCATCGCAAATGTTTTGTGATGCATGACC

-continued

TCATGCATGATCTAGCCACATCACTCGGTGGAGATTTTTATTTTAGATCAGAAGAACTTGGGAAAGAAACAAAGATC

AATACCAAGACTCGTCATTTGTCATTTGCCAAATTCAATTCTTCAGTCTTGGACAACTTTGATGTTATTGGTAGAGCA

AAATTTCTGAGAACCTTCTTGTCCATTATCAATTTTGAAGCTGCTCCATTCAACAATGAGGAGGCACAATGTATCATA

ATGTCGAAGCTTATGTACTTGAGAGTTTTATCATTTTGTGACTTCCAAAGTCTGGATTCTTTGCCTGATTCAATAGGT

AAATTGATCCATCTGCGCTATTTAGATCTCTCTTTTTCAAGAATAGAAACACTGCCAAAGTCATTGTGTAATTTGTAC

AATCTGCAAACTTTGAAGTTTGTGTAGTTGCAGAAAGCTGACTAAGTTTGCCCAGTGACATGCGCAATCTTGTTTAACTT

GCGTCATCTTGGTATTGCTTATACTCCTATAAAAGAGATGCCGAGAGGAATGGGTAAATTAAATCATTTACAACATC

TGGATTTCTTTGTTGTGGGCAAGCACGAAGAGAATGGAATCAAAGAATTGGGAGGACTTTCAAATCTTCGTGGTCAG

CTTGAAATTAGGAAGTTGGAGAATGTTTCCCAAAGTGATGAAGCGTTGGAGGCAAGGATGATGGATAAAAAACACA

TTAATAGTTTACAGTTGGAATGGTCTGGATGTAACAACAACAGTACCAACTTCCAACTTGAAATAGATGTGCTTTGC

AAGTTACAGCCTCACTTTAACATTGAATCGTTGGAAATAAAAGGTTATGAAGGAACCAGATTTCCAGATTGGATGGG

AAATTCTTCCTACTGCAATATGATTAGTCTAAAATTGCGTGATTGTCACAACTGTAGTATGCTTCCTTCACTTGGACA

ACTACCTCTCTCAAGGACCTTGGAATTGCACGATTGAATAGGCTGAAGACTATTGATGCAGGTTTCTACAAGAATG

AAGAATGTCGTTCTGGGACGTCCTTTCCCTCCCTTGAATCTCTGTCCATTGATGACATGCCTTGTTGGGAGGTGTGGA

GTTCCTTCGATTCAGAAGCTTTTCCTGTGCTTAACAGTCTTGAAATACGTGACTGCCCCAAACTAGAGGGAAGTTTGC

CGAATCACCTTCCTGCTCTGACAAAACTTGTGATTAGAAATTTGCGAGCTGCTTGTCTCTTCTCTCCCAACGGCTCCCG

CCATTCAAAGTTTGGAGATATGTAAAAGCAATAAAGTAGCACTGCATGCGTTTCCTCTCTTGGTAGAAACTATAGAA

GTAGAAGGAAGCCCAATGGTGGAGTCCGTGATCGAGGCCATCACTAACATCCAACCAACTTGTCTCCGGTCTTTAAC

ATTAAGGGATTGTTCGTCAGCCGTGTCATTTCCGGGTGGTCGTTTACCTGAATCACTGAAGAGTCTGAGTATCAAGG

ATCTTAAAAAACTGGAATTCCCGACGCAACACAAACATGAGTTACTGGAAACACTGTCAATAGAAAGCAGTTGTGA

TTCACTCACATCTCTTCCATTGGTTACCTTTCCAAATCTCAGATATCTCAGCATCGAAAAGTGTGAAAATATGGAATA

TCTTTTGGTTTCAGGGGCAGAGTCATTTAAGAGTCTGTGTTATTTGTTAATTTACAAATGCCCCAACTTTGTATCATTC

TGGAGAGAAGGATTGCCTGCGCCCAACTTGATTACTTTCAGTGTTTGGGGCTCTGACAAGTTGAAGTCGTTGCCTGA

TGAGATGAGTACTCTTCTCCCAAAGTTAGAAGATCTCACCATATCCAACTGCCCAGAAATTGAGTCCTTTCCAAAAC

GGGGTATGCCACCTAACCTGAGAAGAGTTGAGATTGTCAATTGTGAGAAACTACTGAGCGGCCTAGCATGGCCATC

CATGGGCATGCTTACTCATCTCAATGTTGGGGGTCCATGTGATGGCATCAAGTCCTTCCCTAAAGAGGGTTTGCTGC

CTCCCTCCCTTACGTCTCTGTCTCTATATGACTTGTCAAATCTGGAGATGTTGGACTGCACGGGGCTTCTCCATCTCA

CATCCCTGCAACAATTACAAATTTTTGGATGTCCAAAGCTGGAGAATATGGCTGGAGAAAGTCTTCCTTTCTCTCTA

ATAAAATTAACCATGGTGGAATGTCCTTTGCTGGAAAAACGATGCCGCATGAAGCACCCTCAAATTTGGCCTAAAGT

TCCCACATCCCTGGCATTAAGGTTGGCAATAGATGGATTTAG

>Rpsl-k-4_3'END (SEQ ID NO: 169)

CCACCAAGGAGGACCAACAGGTATCTTCTAAGTCTAACCAACTAGAAAACTATTTCTGTCAAGGATATGTTTCATTT

CATGTCTTTCTACTTTTACGTTTTACTAAATCCAATTCATTCTGAAATGGAAATTGACCTTGTATATATGTTACTGAAT

CTACAGAGAATCAACAAATCATCAAAGGCAACGTGGAAATTGACCTTGTATATATGTTTCGAAGAAGTAACGATAC

AGGTACTAAGTAACAACATTGACAAATACTTAAATATAATGATTCTCCGGAAAAAATGTTACACATCAGTGTTGTTAT

ATTCTAACTTAATTCTCCTTAAGA3TATTGAGGCCAGAGTGAAAATGACCGTGGGAAACTTATTTTTGTTTTTCAGA

TATGGTTGATTGGCCCGGAGAAACTGTACCTACCCATGAATCTAAGTTCAAATTTGAACTAGTGCTAAATGTAACTT

TTAATTTAATTGATGTCAAATTGACACTTCTCAATAGCTGAATTTTTATTTGTGAGGTTTTTCGTTGGGTACAATGTG

AAGGATGAAAAGGTGTACCAAGTGAACTTTAGAAGGATTGGATGATTTCAGCTTATCTCTTATTCCCTGTCCTATAA

ATTAATAATGGTATGATTATTCTAAAAATATGATAGATATGTAGATAAGTAAGAATTGATAAAAGCATAATAAATAT

ACAATTGCAATTCGGTAAACTGAAGAACATACATACTTCTTAGACATTGCTAAAAACAAAATCAAAAAATTGTAGAT

-continued

CATTTTTTTCCTATTGTTCACAAATAAGAATGGTACTATCAATGATCAATCTCATTTCTTTCTTGAAATTATCTATAAA

CAAAACAATTTTCATATTGGTTCATCAAGAAACAATACTTTTATATTTCTATATTATACTTACTTCTATGTTACATGT

CACTATATTTGATTATCATAATTTTTTTAAAGAATTGGTCACTTCACATATATGTATCAGATATATTGGTATCAGAT

ATAGATGCATGAAGCAAATTAAAGTATCAGTACTTTGTAGCAAAACACATTCTTCAAATCATGACATGAGGTAAAAA

AAAATAAGATGATATTTTTGTAAGTATTGGAAAAAAAAAGAGTAAAGCTTCTGAAATCAAAGAGACACTAATTTTCC

ACAACATCCTTCAATTGGGCCCAAGCTTCCTTTCCTATGGACAAATAACTGGTTGTTAGTGCCAGCCTTTTCTTTTTA

CCAGTTTTCCATTGATGGTTAAAAGCTATTATGAACCTGTCACTCCTTAAAATTTCCACCAAAGTTTGGTAAATAAAT

ATATAGGAGAGTGAATAATACAAGTCTTTGCATTCTATCTCTAAGTTATTAGGTATATGAAACAGGTATGGGTATTTG

GTTTTAGAAGGTATGTGGTTCATCACTATTTATATTATTACTACAAGAACCAGGTAAACTTTATTATGGTACAGTAAG

TTTGGTGTGAGTTGTAACTACGTTATATCCATCTCACTTAGCACGATAATTAAATTTAAAAGCAAAAAGATAAGAAA

AAGGCCAATCTAACAATTGTTACCTCTCTTGCATGACAAAATCAGAAACAAAAGTCCCACTCTTTCCTCCATGGTGC

CTGTAATTAACAAGCACTTCAAAAACCAATGTTAATTAATTAATTTCCATAAAAAAAAAAAGGCAAAAGCCAATGA

AATTTAAGGGGTACAACAAAGATTTTGTAGAACGATCATTAATATTAGTGCAACGCACCATGATGAAGTGCATGACAT

AATAATAATGTGGAACCAATCATGATAAGAACAGAAAATAAATCAATGCAATTGCATGATCAGAAAATAACGAGGC

GATATATCATGTTCCTATTGATCAGACAATAGGACAACGTGTTAAAGAAATGTGTCAAGTGCAACAATGAGGGAAC

GGAGAAGAGAAGGATGATAAAGAATGTGGTTATGACTTCTACAAAGTCCAATTATTTACTTTTTTAATTTTTTATATT

TTCCTTTTCACTTTCCTAATAGTTGTCGGATTAAAAGGAGTTTATGGAGTAGATTAGATTGGTTTTGAAAAAGAGAAA

TATCATCTGATACAATTTTTAGTTTTCTTAATTTATTGTTCAATTGATGTAGTTTAAAAAGTTGCACTAACTGAAGTGG

AAAAGGAACATAGGTTGGCAT

Rpsl-k-5
>Rpsl-k-5_5'END (SEQ ID NO: 170)
ACTTCTCTCTGCAAGCTAAAAAGGAGTGTTGTTTAGGAAACAATTTTGAGGCAGGTGTATTTTGGAAAAAATGAGGA

GAGAGCAAGTGTAGTGGAGTAAAAAAATCCTGTAAGGTTTTGTTTGGTAGTAAAAAGAAAAAAATAATTGTAATGA

GAAAAAATAAGTTAGAGGATAAATATCTTCAACACTTAAACAAACAAATAAAAAAGTTTTTCTAGGAAGTTCACTTA

AATCTATTTTAACTATTGATAAAAATTTATACCTGTTGATTTAAAATAAAATTATATTTATTAAATATGATAGGAGAA

AAAATATTTTTTACATATAGTAAAATATTTTCATTGCTGAACTTAAATTTTCTTTATCTCTCATTTTACTATTGTTGTT

TGAGATGATCTCACTGAATATATTAATAATAAAATTTTTATATAAATAAGATTCAAAGGATAATCACCAACCAAGAA

ATTTTATGGAAGTATTTATCAAATAATTACAATAGATATATAACATAAAAAAAAGAGTTGAATTGAATAATAATTTTT

CATGCCATCATTTCAAAAGAATTACTTTAATCACTCTCTTTATATTATTATTATTATTATTATAACATCTTCACAATAT

TTTTTATTTTATTAGTATTTATTGATTTTATTAATAAAAAATCACACACTTTTCTTTTTGCACACATCTTTAATCTACA

TATAAGGATATTCAAATCTTGACTTCATTAATATATATTATTGTTTTTAGGGATCAMTAGCATGTGTCTTTTCTTTAA

TTCTTTCTCTTTTAATTTGTTCAACATTTTTATTGTGTTAATAATTTTTTAATCTCATTTTTTTATTTTCCTCCTAACAAA

ATTTATTCTATATATAAGAATTAATAAAGATTTAAATCTTTTACCACTTGATTAAAAAACATAAATTACTATCAATTA

TTTTAACTTTTTATAAAATCATGATTCAGATCTTTATACAATAACATATCTCATCATGTGTTAGTTGTTTATATCATCA

CTCTTTAAATCTCTTGAGTCTTTAGTTTAGAGGAGCTAAATTCAAAATAGAAATATCAAGAAAGTAACATATGTGAG

GATCAAAAGTAAAGAGACTCCCAACGTGATAAGTCACCCACCACCATAATAATACAAATAATAAAAATAAAAAAGA

CCATACTTTTGTCTTGCACAGCAGAACGAGTGAAGGTGAAGAGAGTTGACTTAAGCCAAATCTCATCACATCAG

>Rpsl-k-5_ORF (SEQ ID NO: 171)
ATGGCTGCAGCACTGGTCGGTGGTGCCTTTCTCTCTGCTTTCCTTGATGTGCTTTTCGACAGGCTGGCTTCACCTGAC

TTTGTTGACTTTGATCCTTGGAAAGAAGCTTAGCAAGAAGTTGCTTCGAAAGTTGGAGACCACTCTCAGAGTGGTTGG

AGCTGTGCTTTGATGATGCCGAGAAGAAACAGATCACAAACACCAATGTCAAACACTGGCTCAATGCTCTCAAAGAT

-continued

GCTGTCTATGAAGCCGATGACTTACTCGACCATGTTTTCACCAAAGCTGCCACCCAAAACAAGGTAAGAAACTTGTT

TTCTCGCTTTTCCGATCGGAAGATCGTTAGTAAGTTGGAGGACATAGTTGTCACCCTAGAGTCTCATTTAAAACTCAA

GGAGAGTCTTGATTTGAAAGAGAGTGCAGTGGAGAACTTGTCATGGAAAGCTCCATCAACATCTCTGGAAGATGGA

TCTCATATATATGGTAGGGAGAAAGATAGGGAGGCCATAATCAAGTTGTTGTCGGAGGATAACAGTGACGGTAGTG

AAGTGTCTGTGGTTCCTATTGTGGGCATGGGTGGGGTTGGAAAAACTACTTTGGCCCAATTGGTGTACAATGATGAG

AATTTGAAAGAGAAATTGATTTTGATTTTAAGGCATGGGTTTTGTGTTTCTCAAGAATTTGATGTTCTGAAGGTCACA

AAAACTATAATACAGGCGGTTACTGGAAATCCTTGTAAATTGAATGATCTGAATCTACTTCATCTTGAATTGATGGA

CAAGCTGAAAGATAAAAAATTCCTAATTGTTTTGGATGATGTTTGGACAGAGGATTATGTTGATTGGAGTCTTCTTAA

GAAACCATTTCAATGTGGGATTATTAGGAGAAGTAAAATTCTTCTAACAACCCGCAGTGAAAAGACAGCCTCCGTA

GTCCAAACGGTTCAAACCTATCATCTAAACCAATTGTCGAATGAAGATTGTTGGTCAGTGTTTGCGAACCATGCGTG

TCTTTCCTTGGAATCGAACGAGAACACAACACTAGAAAAAATTGGAAAGGAGATTGTTAAAAAGTGCGATGGACTG

CCTTTAGCAGCACAGTCCCTTGGAGGCATGTTGAGAAGAAAGCATGACATTGGGGATTGGTATAATATTCTGAATAG

TGACATTTGGGAACTTTCTGAAAGTGAGTGTAAAGTTATTTCCAGCACTGAGACTTAGTTATCATTATCTCCCTCCACA

TTTAAAACGGTGCTTTGTTTATTGTTCGTTGTATCCCCAAGATTACGAATTTGATAAAAATGAATTAATCTTGTTGTG

GATGGCTGAAGATCTTTTGAAGAAACCAAGGAAAGGTAGGACTTTAGAAGAGGTTGGTCATGAGTATTTTGATGATT

TGGTTTCGAGATCATTTTTCCAACGTTCAAGTACAAATAGAAGTAGTTGGCCTTATGGTGAATGTTTTGTGATGCATG

ACCTCATGCATGATCTAGCCAAATCACTCGGTGGAGATTTTTATTTTAGATCAGAAGAACTTGGGAAAGAAACAAAG

ATCAATACTAAGACTCGTCATTTGTCATTTACCAAATTCAATTCTTCAGTCTTGGACAACTTTGATGTTGTTGGTAGA

GCAAAATTTCTGAGAACTTTCTTGTCCATTATCAATTTTGAAGCTGCTCCATTCAACAACGAGGAGGCACAATGTAT

CATTGTGTCGAAGCTTATGTACTTGAGAGTTTTATCATTTTGTGACTTCCAAAGTTTGGATTCTTTGCCTGATTCAATA

GGTAAATTGATCCATCTGCGCTATTTAGATCTTTCTCATTCAAGTGTAGAAACACTGCCAAAGTCATTGTGTAATTTA

TACAATCTGCAAACTTTGAAGTTGTGTAGTTGCAGAAAGCTGACTAAGTTGCCTAGTGACATGTGCAATCTTGTTAA

CTTGCGTCATCTTGAGATACGTGAAACTCCTATAGAAGAGATGCCGAGAGGAATGAGTAAATTAAATCATCTACAAC

ATCTGGATTTCTTTGTTGTGGGCAAGCACAAAGAGAATGGGATCAAAGAATTGGGAGGACTTTCAAATCTTCGTGGT

CGACTTAAAATTAGGAACTTGGAGAATGTTTCCCAAAGTGATGAAGCGTCGGAGGCAAGGATGATGGATAAAAAAC

ACATTAATAGTTTATGGTTGGAATGGTCTAGATGTAATAACAACAGTACCAACTTCCAACTAGAAATAGATGTGCTT

TGCAAGTTACAGCCTCACTTTAACATTGAATCGTTGAGAATAAAAGGCTATAAAGGAACCAGATTTCCAGATTGGAT

GGGAAATTCTTCCTACTGCAATATGATGAGTCTAAAATTGCGTGATTGTGACAACTGTAGTATGCTTCCTTCACTTGG

ACAACTACCTTCTCTCAAGGTCCTTAAGATTGCACGATTGAATAGGCTGAAGACTATTGATGCAGGTTTTTACAAGA

ACGAAGATTGTCGTTCTGGGACGCCCTCCCTCCCTTGAATCTCTGGCCATTCATCAAATGCCTTGTTGGGAGGTGT

GGAGTTCCTTCGATTCAGAAGCTTTTCCTGTGCTTGAAATTCTTGAAATACGTGACTGCCCCAAACTAGAGGGAAGT

TTGCCGAATCACCTTCCTGCTCTGAAAACACTTACAATTAGAAATTGTGAGCTGCTTGGCTCTTCTCTCCCAACGGCT

CCCGCCATTCAAAGTTTGGAGATACGTAAAAGCAATAAAGTAGCACTGCATGCGTTTCCTCTCTTGGTAGAAACTAT

AAAAGTAGAAGGAAGCCCAATGGTGGAGTCCATGATGGAGGCCATCACAAACATCCAACCAACTTGTCTCCGGTCT

TAACATTAAGGGATTGCTCGTCAGCCGTGTCATTTCCGGGTGGTCGTTTACCTGAATCACTGAAGAGTCTGTATATC

TCGGATCTTAAAAAACTGGAATTCCCGACGCAACACAAACATGAGTTACTGGAAACACTGTCAATAGAAAGCAGTT

GTGATTCACTCACATCTCTTCCATTGGTTACCTTTCCAAATCTCAGAGATCTTGAAATCAGAAACTGTGAAAATATGG

AATCTCTTTTGGTATCATTCTGGAGAGAAGGATTGCCTGCGCCCAACTTGATTACTTTCCAAGTGTGGGGCTCTGACA

AGTTGAAGTCGTTGCCTGATGAGATGAGTACTCTTCTCCCAAAGTTAGAACGTCTCCTCATATCCAACTGCCCAGAA

ATTGAGTCGTTTCCAAAACGGGGTATGCCACCTAACCTGAGAATAGTTTGGATTTTCAATTGTGAGAAACTACTGAG

-continued

CAGCCTAGCATGGCCATCCATGGGCATGCTTACTCATCTCTATGTTGGGGGTCGATGTGATGGCATCAAGTCCTTCC

CTAAGGAGGGTTTGCTGCCTCCCTCCCTTACGTATCTGTATCTAAGTGGATTCTCAAATCTGGAGATGTTGGACTGCA

CGGGGCTTCTCCATCTCACATCCCTGCAACAATTAACCATAGACGGATGTCCTTTGCTGGAAAATATGGTGGGAGAA

AGGCTTCCTGACTCTCTAATAAAATTAACCATAAAGAGTTGTCCTTTGCTGAAAAAACGATGCCGGAAGAAGCACCC

TCAAATTTGGCCTAAAATTTCCCACATCCCTGGCATTAAGGTTGACAATAGATGGATTTAG

>Rps1-k-5_3'END (SEQ ID NO: 172)

CCACCAAGGAGGACCAACAGGTATCTTCTAAGTCTAACCAACTAGAAAACTAGTTCTGTCAAGGATATGTTTCATTT

CATGTCTTTCTCCTTTACGTTTTACTAAATCCAATTCATTCTGAAATGGAAATTGACCTTGTATATATGTTACTGAAT

CTACAGAGAATCAACAAATCATCAAAGGCAACGTGGAAATTGACCTTGTATATATGTTTCGAAGAAGTAACGATAC

AGGTACTAAGTAACAACATTGATAAATACTTAAATATAATGATTCTCCGGAAAAATGTTACACATCAGTATTGTTAT

ATTCTAACTTAATTTCTCCTTAAGATTATTGAGGCCAGAGTGAAAATGACCGTGGGAAACTTATTTTTGTTTTTCAGA

TATGGTTGATTGGCCCGGAGAAACTGTACCTACCCATGAATCTAAGTTCAAATTTGAACTAGTGCTAAATGTAACTT

TTAATTTAATTGACGTCAAATTGACACTTTCTCAATAGCTAAATTTTTATTTGTGAGGTTTTTTGTTAGGTACAATGTG

AAGGATGAAAAGGTGTACCAAGTGAACTTTAGAAGGATTGGATGATTTCAGCTTATCTCTTATCTCCTGTCCTATAA

ATTAATAGTGGTATGATTATTCTAAAAATATGATAGATATGTAGATACGTAAGAATTGATAAAAGCATAATAAATAT

ACAATTGCAATTCGGTAAATTGAAGAACATACATACTTCTTAGACATTGCTAAAAACAAAATCAAAAAATTGTAGAT

CATTTTTTCCTATTGTTCACAAATAAGAATGGTACTATCAATGATCAATCTCATTTCTTTCTTGAAATTATCTATAAAC

AAAACAATTTCATATTTGGTTCATCAAGAAACAATACTTTTTATATTTCTATATTATATTTACTTCTATGTTACATGT

CACTATATTTGATTATCATAATTTTTTTTAAAAGAATTGGTCACTTTACATATATGTACCAGTGAAATATATCAATAT

ATTGGTATCGGATATAGATGCATGAAGCAAATTAAAGTATCAGTACTTTGTAGCAAAACACATTCTTCAAATCATGA

CATGAGGTAAAAAAATATGATGATATTTTTGTAAGTATTGGAAAAAAAAAAAAAAGTAAAGCTTCTGAAATCAAAG

AGACACTAATTTTCCACAACATCCTTCAATTGGGCCCAAGCTTCCTTTCCTATTGACAAATAACTGGTTGTTAGTGCC

AGCTTTTTCTTTTTCTAGTTTTCCATTGATGGTTAAAAGCTAATATGAACCTGTCACTCCTTAAAATTTCCACCAAAG

TTTGGTAAATAAATATATAGGAGAGTGAATAATGCAAGCCTTGCATTCTATCTCTAAGTTACTAGGTATATGAAACA

GGTATGGGTATGGTTTAGAAGGTATGTGGTTCATCACTATTTATATTTTTACTACAAGAACCAGGTAAACTTTATTA

TGGTACAGTAAATTTAGTGTGAGGTTGTAACTACGTTATATCCATCTAACTTAGCACGATAATTAAATTTAAAAGCA

AAAAGATAAGAAAAAGGCCAATCTAACAATTGTTACCTCTCTTGCATGAAAAAATCAGAAACAAAAGCCCCACTCT

TTCCTCCATGGTGCCTGTAATTAACAAGCACTTCAAAAATCAATGTTAATTAATTAATTTCCATAAGAAAAAAAAGA

CAGAAGCTAATGAAATTTAAGGGGTACAACAAAGATTTGTAGAACGATCATTAATATTAGTGCAACACATCATGATG

AAGTGCATGACATAATAATAATGTGAAACCAATCATGATAAGAACAGAAAATAAATCAGTGCAATTACATGATTAG

AAAATAAAGAGGCGATATATCATATTCCTATTGATCAGACAATATGACAACGTGTTAAACAAATGTGTCAGGTGCAA

TAATGAGGGGATAGAGAAGAGAAGGATGATAAAGAATGTGGTTATGACTTCTACAAAGTCGAATTATTTACTTTTTT

AATTTTTTATATTTTCCTTTTCACTTTTCTAATAGTTGGCCGATTAAGAGGAGTTTATAGAGTAGATTAAATTGGTTTT

GAAAAAGAGAAATATCATCTTATACAATTTTTGGTTTTCTTAATTCATTGTTCAATTGATGTAGTTTAAAATTTAAAT

ATGATTTAATAAGTTTGGATTGATCTCGA

Sequence alignment of 5′ ends

```
Rps1-k-2_5end   1  ------------------------------------------------------------------
Rps1-k-1_5end   1  ------------------------------------------------------------------
Rps1-k-5_5end   1  ACTTCTCTCTGCAAGCTAAAAAGGAGTGTTGTTTAGGAAACAATTTTGAGGCAGGTGTATTTTGGAAAAA
Rps1-k-3_5end   1  ACTTCTCTCTGCAAGCTAAAAAGGAGTGTTGTTTAGGAAACAATTTTGAGGCAGGTGTATTTTGGAAAAA
Rps1-k-4_5end   1  ACTTCTCTCTGCAAGCTAAAAAGGAGTGTTGTTTAGGAAACAATTTTGAGGCAGGTGTATTTTGGAAAAA
consensus       1  ..................................................................
```

-continued

```
Rps1-k-2_5end    1  ----------------------------------------------------------------------
Rps1-k-1_5end    1  ----------------------------------------------------------------------
Rps1-k-5_5end   71  AT-GAGGAGAGAGCAAGTGTAGTGGAGTAAAAAAATCCTGTAACGTTTTGTTTGGTAGTAAAAAGAAAAA
Rps1-k-3_5end   71  AT-GAGGAGAGAGCAAGTGTAGTGGAGTAAAAAAATCCTGTAACGTTTTGTTTGGTAGTAAAAAGAAAAA
Rps1-k-4_5end   71  ATTGAGGAGAGAGCAAGTGTAGTGGAGTAAAAAAATCCTATAACATTTTGTTTGATACTAAAAAGAAAAA
consensus       71  .. ...................................................... ............

Rps1-k-2_5end    1  ----------------------------------------------------------------------
Rps1-k-1_5end    1  ----------------------------------------------------------------------
Rps1-k-5_5end  140  AATAATTGTAATGAGAAAAAAATAAGTTAGAGGATAAATATCTTCAACACTTAAACAAACAAATAAAAAAG
Rps1-k-3_5end  140  AATAATTGTAATGAGAAAAAAATAAGTTAGAGGATAAATATCTTCAACACTTAAACAAACAAATAAAAAAG
Rps1-k-4_5end  141  AATAATTGTGATGAGAAAAAAATAAGTTAGAGGATAAATATCTTCAACACTTAAACAAACAAATAAAAAAG
consensus      141  ......................................................................

Rps1-k-2_5end    1  ----------------------------------------------------------------------
Rps1-k-1_5end    1  ----------------------------------------------------------------------
Rps1-k-5_5end  210  TTTTTCTAGGAAGTTCACTTAAATCTATTTTAACTATTGATAAAAATTTA--TACCTGTTG-ATTTAA-A
Rps1-k-3_5end  210  TTTTTCTAGGAAGTTCACTTAAATCTATTTTAACTATTGATAAAAATTTA--TACCTGTTG-ATTTAA-A
Rps1-k-4_5end  211  TTTTTCTAGAAAGTTCACTTAAATCTATTTTCACTATTGATAAAAATTTA--TACCTGTTG-ATTTAA-A
consensus      211  ............................... ..................  ......... ...... .

Rps1-k-2_5end    1  ----------------------------------------------------------------------
Rps1-k-1_5end    1  ----------------------------------------------------------------------
Rps1-k-5_5end  276  ATAAAATT-AT-----ATTTT----------------ATTAAATATGATAGGAGAAAAAATATTTTTTACA
Rps1-k-3_5end  276  ATAAAATT-AT-----ATTTT----------------ATTAAATATGATAGGAGAAAAAATATTTTTTACA
Rps1-k-4_5end  277  ATAAAATT-AT-----ATTTTTATAAAAATTATATTTATTAAATATGATAGGAGAAAAA-TATTTTTTACA
consensus      281  ........ ..     .....                ...................... ...........

Rps1-k-2_5end    1  ----------------------------------------------------------------------
Rps1-k-1_5end    1  ----------------------------------------------------------------------
Rps1-k-5_5end  324  TATAGTAAAATATTTTCATTTGCTGAACTTAAATTTCTTTATCTCTCATTTTACTATTGTTGTTTGAGA
Rps1-k-3_5end  324  TATAGTAAAATATTTTCATTTGCTGAACTTAAATTTCTTTATCTCTCATTTTACTATTGTTGTTTGAGA
Rps1-k-4_5end  340  TATAGTAAAATATTTTCATTTGCTGGACTTAAATTTCTTTATCTCTCATTTTAGTATTGTTGTTTGAGA
consensus      351  ..................................................... ...............

Rps1-k-2_5end    1  ----------------------------------------------------------------------
Rps1-k-1_5end    1  -----TCACTGAATATATT----------AATAATAAAATTTTTATATAAATAAGATTCAAAGGATAATC
Rps1-k-5_5end  394  TGATCTCACTGAATATATT----------AATAATAAAATTTTTATATAAATAAGATTCAAAGGATAATC
Rps1-k-3_5end  394  TGATCTCACTGAATATATT----------AATAATAAAATTTTTATATAAATAAGATTCAAAGGATAATC
Rps1-k-4_5end  410  TGATCTCACTAAATATATTTTACTTGACTAATAATAAAAATTTTATATAGATAAGATTCAAAGGATAATC
consensus      421  ...................          .........................................

Rps1-k-2_5end    1  ----------------------------------------------------------------------
Rps1-k-1_5end   56  ACCAACCAAGAAATTTTATGGAAGTATTTATCAAATAATTACAATAGATATATAACATAAAAAAAAGAGT
Rps1-k-5_5end  454  ACCAACCAAGAAATTTTATGGAAGTATTTATCAAATAATTACAATAGATATATAACATAAAAAAAAGAGT
Rps1-k-3_5end  454  ACCAACCAAGAAATTTTATGGAAGTATTTATCAAATAATTACAATAGATATATAACATAAAAAAAAGAGT
Rps1-k-4_5end  480  ACCAACCAAAAATTTTTATGGAAGTATTTATCAAATAATTACAATAGATATATAACATAAAAAAA-GAGT
consensus      491  ......................................................................

Rps1-k-2_5end    1  ----------------------------------------------------------------------
Rps1-k-1_5end  126  TGAATTGAATAATAATTTTTCATGCCATCATTTCAAAAGAATTACTTTAATCACTCTCT-TTAT-ATTAT
Rps1-k-5_5end  524  TGAATTGAATAATAATTTTTCATGCCATCATTTCAAAAGAATTACTTTAATCACTCTCT-TTAT-ATTAT
Rps1-k-3_5end  524  TGAATTGAATAATAATTTTTCATGCCATCATTTCAAAAGAATTACTTTAATCACTCTCT-TTAT-ATTAT
Rps1-k-4_5end  549  TGAATTGAATAATAATTTTTCATGCCA------------AATTACTTTAATCACTCTATATTATTATTAT
consensus      561  .........................................................  .... .....

Rps1-k-2_5end    1  ----------------------------------------------------------------------
Rps1-k-1_5end  194  TATTATAATTATTATAACATCTTCACAATATTTTTTATTTTATTAGTAT------------TTATTAATT
Rps1-k-5_5end  592  TATTATAATTATTATAACATCTTCACAATATTTTTTATTTTATTAGTAT------------TTATTAATT
Rps1-k-3_5end  592  TATTATAATTATTATAACATCTTCACAATATTTTTTATTTTATTAGTAT------------TTATTAATT
Rps1-k-4_5end  607  TATTATCATTATTATAACATCTTCACAATATTCTTTATTTTATTAGTATCTATTATTTATTTTATTAATT
consensus      631  ..........................................                  .........

Rps1-k-2_5end    1  ----------------------------------------------------------------------
Rps1-k-1_5end  252  TTATTTAATAAAAAATCACACACTTTTCTTTTTGCACACATCTTTAATCTACATATAAGGATATTCAAAT
Rps1-k-5_5end  650  TTATTTAATAAAAAATCACACACTTTTCTTTTTGCACACATCTTTAATCTACATATAAGGATATTCAAAT
Rps1-k-3_5end  650  TTATTTAATAAAAAATCACACACTTTTCTTTTTGCACACATCTTTAATCTACATATAAGGATATTCAAAT
Rps1-k-4_5end  677  TTATTTAATAAAAAATCACAAACTTTTCTTTTTGCACACATCTTTAACGTACATATAAAGATATTCAAAT
consensus      701  ......................................................................

Rps1-k-2_5end    1  ----------------------------------------------------------------------
Rps1-k-1_5end  322  CTTGACTTCATTAATATATATTATTGTTTTTAGGGATCAATTAGCATGTGTCTTTTCTTTAATTCTTTCT
Rps1-k-5_5end  720  CTTGACTTCATTAATATATATTATTGTTTTTAGGGATCAATTAGCATGTGTCTTTTCTTTAATTCTTTCT
Rps1-k-3_5end  720  CTTGACTTCATTAATATATATTATTGTTTTTAGGGATCAATTAGCATGTGTCTTTTCTTTAATTCTTTCT
Rps1-k-4_5end  747  CTTGAATTCATTAATAT-TAT----GTTTTTAGGGATCAATTAGCATGTGTCCTTTCTTTAATTCTTTCT
consensus      771  ......................................................................

Rps1-k-2_5end    1  ----------------------------------------------------------------------
Rps1-k-1_5end  392  CTTTTAATTTGTTCAACATCTTTTATTGTGTTAATAATTTTTTAATCTCATTTTTTTATTTTCCTCCTAA
Rps1-k-5_5end  790  CTTTTAATTTGTTCAACAT-TTTTATTGTGTTAATAATTTTTTAATCTCATTTTTTTATTTTCCTCCTAA
Rps1-k-3_5end  790  CTTTTAATTTGTTCAACAT-TTTTATTGTGTTAATAATTTTTTAATCTCATTTTTTTATTTTCCTCCTAA
Rps1-k-4_5end  812  CTTTTAATTTGTTCAACAT-TTTTTTGTCTTAATAATTTTTTAATCTCATTTTTTTATTTTCCTCCTAA
consensus      841  ................... ..................................................

Rps1-k-2_5end    1  ----------------------------------------------------------------------
Rps1-k-1_5end  462  CAAAATTTATTCTATATATAAGAATTAATAAAGATTTAAATCTTTTACCACTTGATTAAAAAACATAAAT
Rps1-k-5_5end  859  CAAAATTTATTCTATATATAAGAATTAATAAAGATTTAAATCTTTTACCACTTGATTAAAAAACATAAAT
Rps1-k-3_5end  859  CAAAATTTATTCTATATATAAGAATTAATAAAGATTTAAATCTTTTACCACTTGATTAAAAAACATAAAT
Rps1-k-4_5end  881  CAAAATTTATTCTATATATAAGAATTAATAAAAATTTAAATCTTTTACCACTTGATTAAAAAACATAAAT
consensus      911  ......................................................................

Rps1-k-2_5end    1  ----------------------------------------------------------------------
Rps1-k-1_5end  532  TACTATCAATTATTTTAACTTTTTATAAAATCATGATTCAG------ATCTTTATACAATAACATATCTC
Rps1-k-5_5end  929  TACTATCAATTATTTTAACTTTTTATAAAATCATGATTCAG------ATCTTTATACAATAACATATCTC
Rps1-k-3_5end  929  TACTATCAATTATTTTAACTTTTTATAAAATCATGATTCAG------ATCTTTATACAATAACATATCTC
Rps1-k-4_5end  951  CATTATCAATTATTTTAAATTTT--TAAAATCATGATTCAGTATTAGATCTTTATAAAATACCATATCTC
consensus      981  .........................................      .......................
```

-continued

```
Rps1-k-2_5end     1  ----------------------------------------------------------------------
Rps1-k-1_5end   596  ATCATGTGTTAGTTGTTTA---------------------------------------------------
Rps1-k-5_5end   993  ATCATGTGTTAGTTGTTTA---------------------------------------------------
Rps1-k-3_5end   993  ATCATGTGTTAGTTGTTTA---------------------------------------------------
Rps1-k-4_5end  1019  ----TATGACAATT--TTAATGATTAGGTTGAAATATAAACTAACACGAATTTAAGTAAATATTCACTA
consensus      1051  ......................................................................

Rps1-k-2_5end     1  -------------------------------------------------------------------TTT
Rps1-k-1_5end   615  ----------------------------------------------------------------------
Rps1-k-5_5end  1012  ----------------------------------------------------------------------
Rps1-k-3_5end  1012  ----------------------------------------------------------------------
Rps1-k-4_5end  1083  TTTACTTTCACATTGAAAAATTGATTTTAAATTTTAACTTTAGAAAAAAAATTCTAAGTTGAGGATCTTT
consensus      1121

Rps1-k-2_5end     4  ACATAACTTTTGGATTTAACAAAAAAATTCATTTTCAATTTTACTATTAACTTATTTTTTAAATAAAAAT
Rps1-k-1_5end   615  ----------------------------------------------------------------------
Rps1-k-5_5end  1012  ----------------------------------------------------------------------
Rps1-k-3_5end  1012  ----------------------------------------------------------------------
Rps1-k-4_5end  1153  ACATAACTTTTGGATTTAACAAAAAAATTCATTTTCAATTTTACTATTAACTTATTTTTTAAATAAAAAT
consensus      1191

Rps1-k-2_5end    74  ATCCAAAACACATGTGCAAACTGCTTCAATACAACTTGTCTCACAGCATCAAAGCACAGGAACATAATTA
Rps1-k-1_5end   615  ----------------------------------------------------------------------
Rps1-k-5_5end  1012  ----------------------------------------------------------------------
Rps1-k-3_5end  1012  ----------------------------------------------------------------------
Rps1-k-4_5end  1223  ATCCAAAACACATGTGCAAACTGCTTCAATACAACTTGTCTCACAGCATCAAAGCACAGGAACATAATTA
consensus      1261

Rps1-k-2_5end   144  TGCACAGTACCCTTGCAGCCATCCACACATATCACCAAGAAAAAAACACACACCACTGCTCCACACGGTT
Rps1-k-1_5end   615  ----------------------------------------------------------------------
Rps1-k-5_5end  1012  ----------------------------------------------------------------------
Rps1-k-3_5end  1012  ----------------------------------------------------------------------
Rps1-k-4_5end  1293  TGCACAGTACCCTTGCAGCCATCCACACATATCACCAAGAAAAAAACACACACCACTGCTCCACACGGTT
consensus      1331

Rps1-k-2_5end   214  TGGAAAGCGAGAAAGCTGGCCATCACTAACTTTAATTATAGCATTTTAGAAATATAATCCATTTTTTTAA
Rps1-k-1_5end   615  ----------------------------------------------------------------------
Rps1-k-5_5end  1012  ----------------------------------------------------------------------
Rps1-k-3_5end  1012  ----------------------------------------------------------------------
Rps1-k-4_5end  1363  TGGAAAGCGAGAAAGCTGGCCATCACTAACTTTAATTATAGCATTTTAGAAATATAATCCATTTTTTTAA
consensus      1401

Rps1-k-2_5end   284  AATTAACGGTAGAATATCATCACTCTTTAAATCTCTTGAGTCTTTAGTTTAGAGGAGCTAAATTTAAAA
Rps1-k-1_5end   615  --------------TATCATCACTCTTTAAATCTCTTGAGTCTTTAGTTTAGAGGAGCTAAATTCAAAA
Rps1-k-5_5end  1012  --------------TATCATCACTCTTTAAATCTCTTGAGTCTTTAGTTTAGAGGAGCTAAATTCAAAA
Rps1-k-3_5end  1012  --------------TATCATCACTCTTTAAATCTCTTGAGTCTTTAGTTTAGAGGAGCTAAATTCAAAA
Rps1-k-4_5end  1433  AATTAACGGTAGAATATCATCACTCTTTAAATCTCTTGAGTCTTTAGTTTAGAGGAGCTAAATTTAAAA
consensus      1471  ***************************************************************.****

Rps1-k-2_5end   354  TAGAAATATCAAGAAAGCAACAT--GTGCGGATCAAAAGTAAAGAGACTCCCAACGTGATAAGTCACCCA
Rps1-k-1_5end   670  TAGAAATATCAAGAAAGTAACATATGTGAGGATCAAAAGTAAAGAGACTCCCAACGTGATAAGTCACCCA
Rps1-k-5_5end  1067  TAGAAATATCAAGAAAGTAACATATGTGAGGATCAAAAGTAAAGAGACTCCCAACGTGATAAGTCACCCA
Rps1-k-3_5end  1067  TAGAAATATCAAGAAAGTAACATATGTGAGGATCAAAAGTAAAGAGACTCCCAACGTGATAAGTCACCCA
Rps1-k-4_5end  1503  TAGAAATATCAAGAAAGCAACAT--GTGCGGATCAAAAGTAAAGAGACTCCCAACGTGATAAGTCACCCA
consensus      1541  *****************.*****..***.*****************************************

Rps1-k-2_5end   422  CCACCA-----ATTC---------------------CCTTGCCTTTTGTCTTGCACAGCAGAACGAG
Rps1-k-1_5end   740  CCACCATAATAATACAAATAATAAAAATAAAAAAGACCATAC-TTTTGTCTTGCACAGCAGAACGAG
Rps1-k-5_5end  1137  CCACCATAATAATACAAATAATAAAAATAAAAAAGACCATAC-TTTTGTCTTGCACAGCAGAACGAG
Rps1-k-3_5end  1137  CCACCATAATAATACAAATAATAAAAATAAAAAAGACCATAC-TTTTGTCTTGCACAGCAGAACGAG
Rps1-k-4_5end  1571  CCACCA-----ATTC---------------------CCTTGCCTTTTGTCTTGCACAGCAGAACGAG
consensus      1611  ******.....**.*.....................**.*.* *************************

Rps1-k-2_5end   466  AGGTGAAGAGAGTTGACTTAAGCCAAATCTCATCACATCAGTTCATAGCAACCAATTCCCTTGCCTTTGT
Rps1-k-1_5end   809  AGGTGAAGAGAGTTGACTTAAGCCAAATCTCATCACATCAGTTCATAGCAACCAATTCCCTTGCCTTTGT
Rps1-k-5_5end  1206  AGGTGAAGAGAGTTGACTTAAGCCAAATCTCATCACATCAGTTCATAGCAACCAATTCCCTTGCCTTTGT
Rps1-k-3_5end  1206  AGGTGAAGAGAGTTGACTTAAGCCAAATCTCATCACATCAGTTCATAGCAACCAATTCCCTTGCCTTTGT
Rps1-k-4_5end  1615  AGGTGAAGAGAGTTGACTTAAGCCAAATCTCATCACATCAGTTCATAGCAACCAATTCCCTTGCCTTTGT
consensus      1681  **********************************************************************

Rps1-k-2_5end   536  CTTTCTACTCTGATCATCTTTTGTTCTTGAGATA  (SEQ ID NO:161)
Rps1-k-1_5end   879  CTTTCTACTCTGATCATCTTTTGTTCTTGAGATA  (SEQ ID NO:169)
Rps1-k-5_5end  1276  CTTTCTACTCTGATCATCTTTTGTTCTTGAGATA  (SEQ ID NO:167)
Rps1-k-3_5end  1276  CTTTCTACTCTGATCATCTTTTGTTCTTGAGATA  (SEQ ID NO:163)
Rps1-k-4_5end  1685  CTTTCTACTCTGATCATCTTTTGTTCTTGAGATA  (SEQ ID NO:165)
consensus      1751  **********************************
```

Sequence alignment of ORFs showing the variable nucleic acid residues

```
Rps1-k-3    1  ATGGCTGCAGCACTGGTCGGTGGTGCCTTTCTCTCTGCTTTCCTTGATGTGCTTTTCGACAGGCTGGCTT
Rps1-k-1    1  ATGGCTGCAGCACTGGTCGGTGGTGCCTTTCTCTCTGCTTTCCTTGATGTGCTTTTCGACAGGCTGGCTT
Rps1-k-5    1  ATGGCTGCAGCACTGGTCGGTGGTGCCTTTCTCTCTGCTTTCCTTGATGTGCTTTTCGACAGGCTGGCTT
Rps1-k-2    1  ATGGCAGCAGCACTGGTCGGTGGTGCCTTCCTCTCTGCTTTTCTTGATGTGGTTTTCGACAGGCTGGCTT
Rps1-k-4    1  ATGGCAGCAGCACTGGTCGGTGGTGCCTTCCTCTCTGCTTTTCTTGATGTGGTTTTCGACAGGCTGGCTT
consensus   1  *****.***********************.***********.*********.******************

Rps1-k-3   71  CACCTGACTTTGTTGACTTGATCCTTGGAAAGAAGCTTAGCAAGAAGTTGCTTCGAAAGTTGGAGACCAC
Rps1-k-1   71  CACCTGACTTTGTTGACTTGATCCTTGGAAAGAAGCTTAGCAAGAAGTTGCTTCGAAAGTTGGAGACCAC
Rps1-k-5   71  CACCTGACTTTGTTGACTTGATCCTTGGAAAGAAGCTTAGCAAGAAGTTGCTTCGAAAGTTGGAGACCAC
Rps1-k-2   71  CACCTGAGTTTGTTGACTTGATCCGTGGAAAGAAGCTTAGCAAGAAGTTGCTTCAAAAGTTGGAGACCAC
Rps1-k-4   71  CACCTGAGTTTGTTGACTTGATCCGTGGAAAGAAGCTTAGCAAGAAGTTGCTTCAAAAGTTGGAGACCAC
consensus  71  *******.****************.*****************************.***************
```

-continued

```
Rps1-k-3  141 TCTCAGAGTGGTTGGAGCTGTGCTTGATGATGCCGAGAGAAACAGATCACAAACACCAATGTCAAACAC
Rps1-k-1  141 TCTCAGAGTGGTTGGAGCTGTGCTTGATGATGCCGAGAGAAACAGATCACAAACACCAATGTCAAACAC
Rps1-k-5  141 TCTCAGAGTGGTTGGAGCTGTGCTTGATGATGCCGAGAGAAACAGATCACAAACACCAATGTCAAACAC
Rps1-k-2  141 TCTCAGAGTGGTTGGAGCTGTGCTTGATGATGCCGAGAGAAACAGATCACAAACACCAATGTCAAACAC
Rps1-k-4  141 TCTCAGAGTGGTTGGAGCTGTGCTTGATGATGCCGAGAGAAACAGATCACAAACACCAATGTCAAACAC
consensus 141 **********************************************************************

Rps1-k-3  211 TGGCTCAATGCTCTCAAAGATGCTGTCTATGAAGCCGATGACTTACTCGACCATGTTTTCACCAAAGCTG
Rps1-k-1  211 TGGCTCAATGCTCTCAAAGATGCTGTCTATGAAGCCGATGACTTACTCGACCATGTTTTCACCAAAGCTG
Rps1-k-5  211 TGGCTCAATGCTCTCAAAGATGCTGTCTATGAAGCCGATGACTTACTCGACCATGTTTTCACCAAAGCTG
Rps1-k-2  211 TGGCTCAATGATCTCAAACATGCTGTCTATGAAGCCGATGACTTACTCGACCATGTTTTCACCAAAGCTG
Rps1-k-4  211 TGGCTCAATGATCTCAAACATGCTGTCTATGAAGCCGATGACTTACTCGACCATGTTTTCACCAAAGCTG
consensus 211 **********.*******.***************************************************

Rps1-k-3  281 CCACCCAAAACAAGGTAAGAAACTTGTTTTCTCGCTTTTCCGATCGGAAGATCGTTAGTAAGTTGGAGGA
Rps1-k-1  281 CCACCCAAAACAAGGTAAGAAACTTGTTTTCTCGCTTTTCCGATCGGAAGATCGTTAGTAAGTTGGAGGA
Rps1-k-5  281 CCACCCAAAACAAGGTAAGAAACTTGTTTTCTCGCTTTTCCGATCGGAAGATCGTTAGTAAGTTGGAGGA
Rps1-k-2  281 CCACCCAAAACAAGGTAAGAGACTTGTTTTCTCGCTTTTCCGATAGGAAGATCGTTAGTAAGTTGGAGGA
Rps1-k-4  281 CCACCCAAAACAAGGTAAGAGACTTGTTTTCTCGCTTTTCCGATAGGAAGATCGTTAGTAAGTTGGAGGA
consensus 281 ************************.******************.*************************

Rps1-k-3  351 CATAGTTGTCACCCTAGAGTCTCATTTAAAACTCAAGGAGAGTCTTGATTTGAAAGAGAGTGCAGTGGAG
Rps1-k-1  351 CATAGTTGTCACCCTAGAGTCTCATTTAAAACTCAAGGAGAGTCTTGATTTGAAAGAGAGTGCAGTGGAG
Rps1-k-5  351 CATAGTTGTCACCCTAGAGTCTCATTTAAAACTCAAGGAGAGTCTTGATTTGAAAGAGAGTGCAGTGGAG
Rps1-k-2  351 CATAGTTGTCACACTTGAGTCTCATTTAAAACTCAAGGAGAGTCTTGATTTGAAAGAGAGTGCAGTGGAG
Rps1-k-4  351 CATAGTTGTCACACTTGAGTCTCATTTAAAACTCAAGGAGAGTCTTGATTTGAAAGAGAGTGCAGTGGAG
consensus 351 ************.**.******************************************************

Rps1-k-3  421 AACTTGTCATGGAAAGCTCCATCAACATCTCTGGAAGATGGATCTCATATATATGGTAGGGAGAAAGATA
Rps1-k-1  421 AACTTGTCATGGAAAGCTCCATCAACATCTCTGGAAGATGGATCTCATATATATGGTAGGGAGAAAGATA
Rps1-k-5  421 AACTTGTCATGGAAAGCTCCATCAACATCTCTGGAAGATGGATCTCATATATATGGTAGGGAGAAAGATA
Rps1-k-2  421 AACTTGTCATGGAAAGCTCCATCAACATCTCTGGAAGATGGATCTCATATATATGGTAGGGAGAAAGATA
Rps1-k-4  421 AACTTGTCATGGAAAGCTCCATCAACATCTCTGGAAGATGGATCTCATATATATGGTAGGGAGAAAGATA
consensus 421 **********************************************************************

Rps1-k-3  491 GGGAGGCCATAATCAAGTTGTTGTCGGAGGATAACAGTGACGGTAGTGAAGTGTCTGTGGTTCCTATTGT
Rps1-k-1  491 GGGAGGCCATAATCAAGTTGTTGTCGGAGGATAACAGTGACGGTAGTGAAGTGTCTGTGGTTCCTATTGT
Rps1-k-5  491 GGGAGGCCATAATCAAGTTGTTGTCGGAGGATAACAGTGACGGTAGTGAAGTGTCTGTGGTTCCTATTGT
Rps1-k-2  491 AGGAGGCCATAATCAAGTTGTTGTCGGAGGATAACAGTGACGGTAGAGAAGTGTCTGTGGTTCCTATTGT
Rps1-k-4  491 AGGAGGCCATAATCAAGTTGTTGTCGGAGGATAACAGTGACGGTAGAGAAGTGTCTGTGGTTCCTATTGT
consensus 491 ********************************************** .***********************

Rps1-k-3  561 GGGCATGGGTGGGGTTGGAAAAACTACTTTGGCCCAATTGGTGTACAATGATGAGAATTTGAAAGAGAAA
Rps1-k-1  561 GGGCATGGGTGGGGTTGGAAAAACTACTTTGGCCCAATTGGTGTACAATGATGAGAATTTGAAAGAGAAA
Rps1-k-5  561 GGGCATGGGTGGGGTTGGAAAAACTACTTTGGCCCAATTGGTGTACAATGATGAGAATTTGAAAGAGAAA
Rps1-k-2  561 GGGCATGGGTGGGGTTGGAAAAACTACTTTGGCCCAATTGGTGTACAACGATGAGAATTTGAAACAGATA
Rps1-k-4  561 GGGCATGGGTGGGGTTGGAAAAACTACTTTGGCCCAATTGGTGTACAACGATGAGAATTTGAAACAGATA
consensus 561 ************************************************.***************.***.*

Rps1-k-3  631 TTTGATTTTGATTTTAAGGCATGGGTTTGTGTTTCTCAAGAATTTGATGTTCTGAAGGTCACAAAAACTA
Rps1-k-1  631 TTTGATTTTGATTTTAAGGCATGGGTTTGTGTTTCTCAAGAATTTGATGTTCTGAAGGTCACAAAAACTA
Rps1-k-5  631 TTTGATTTTGATTTTAAGGCATGGGTTTGTGTTTCTCAAGAATTTGATGTTCTGAAGGTCACAAAAACTA
Rps1-k-2  631 TTTGATTTTGATTTTAAGGCATGGGTTTGTGTTTCTCAAGAATTTGATGTTCTCAAGGTCACAAAAACTA
Rps1-k-4  631 TTTGATTTTGATTTTAAGGCATGGGTTTGTGTTTCTCAAGAATTTGATGTTCTCAAGGTCACAAAAACTA
consensus 631 *****************************************************.****************

Rps1-k-3  701 TAATACAGGCGGTTACTGGAAATCCTTGTAAATTGAATGATCTGAATCTACTTCATCTTGAATTGATGGA
Rps1-k-1  701 TAATACAGGCGGTTACTGGAAATCCTTGTAAATTGAATGATCTGAATCTACTTCATCTTGAATTGATGGA
Rps1-k-5  701 TAATACAGGCGGTTACTGGAAATCCTTGTAAATTGAATGATCTGAATCTACTTCATCTTGAATTGATGGA
Rps1-k-2  701 TAATAGAGGCGCTGACTGGAAAGGCTTGTAAATTGAATGATCTGAATCTACTTCATCTTGAATTGATGGA
Rps1-k-4  701 TAATAGAGGCGCTGACTGGAAAGGCTTGTAAATTGAATGATCTGAATCTACTTCATCTTGAATTGATGGA
consensus 701 *****.*******.********..**********************************************

Rps1-k-3  771 CAAGCTGAAAGATAAAAAATTCCTAATTGTTTTGGATGATGTTTGGACAGAGGATTATGTTGATTGGAGT
Rps1-k-1  771 CAAGCTGAAAGATAAAAAATTCCTAATTGTTTTGGATGATGTTTGGACAGAGGATTATGTTGATTGGAGT
Rps1-k-5  771 CAAGCTGAAAGATAAAAAATTCCTAATTGTTTTGGATGATGTTTGGACAGAGGATTATGTTGATTGGAGT
Rps1-k-2  771 CAAGCTGAAAGATAAAAAATTCTTAATTGTTTTGGATGATGTTTGGACAGAGGATTATGTTGATTGGCGT
Rps1-k-4  771 CAAGCTGAAAGATAAAAAATTCTTAATTGTTTTGGATGATGTTTGGACAGAGGATTATGTTGATTGGCGT
consensus 771 **********************.********************************************.**

Rps1-k-3  841 CTTCTTAAGAAACCATTTCAATGTGGGATTATTAGGAGAAGTAAAATTCTTCTAACAACCCGCAGTGAAA
Rps1-k-1  841 CTTCTTAAGAAACCATTTCAATGTGGGATTATTAGGAGAAGTAAAATTCTTCTAACAACCCGCAGTGAAA
Rps1-k-5  841 CTTCTTAAGAAACCATTTCAATGTGGGATTATTAGGAGAAGTAAAATTCTTCTAACAACCCGCAGTGAAA
Rps1-k-2  841 CTTCTTAAGAAACCATTTAACCGTGGGATTATTAGGAGAAGTAAAATTCTTCTAACAACCCGCAGTGAAA
Rps1-k-4  841 CTTCTTAAGAAACCATTTAACCGTGGGATTATTAGGAGAAGTAAAATTCTTCTAACAACCCGCAGTGAAA
consensus 841 ******************.*..************************************************

Rps1-k-3  911 AGACAGCCTCCGTAGTCCAAACGGTTCAAACCTATCATCTAAACCAATTGTCGAATGAAGATTGTTGGTC
Rps1-k-1  911 AGACAGCCTCCGTAGTCCAAACGGTTCAAACCTATCATCTAAACCAATTGTCGAATGAAGATTGTTGGTC
Rps1-k-5  911 AGACAGCCTCCGTAGTCCAAACGGTTCAAACCTATCATCTAAACCAATTGTCGAATGAAGATTGTTGGTC
Rps1-k-2  911 AAACAGCATCTGTAGTCCAAACTGTTCACACCTATCATCTAAACCAATTGTCGAATGAAGATTGTTGGTC
Rps1-k-4  911 AAACAGCATCTGTAGTCCAAACTGTTCACACCTATCATCTAAACCAATTGTCGAATGAAGATTGTTGGTC
consensus 911 *.*****.**.***********.*****.*****************************************

Rps1-k-3  981 AGTGTTTGCGAACCATGCGTGTCTTTCCTTGGAATCGAACGAGAACACA---ACACTAGAAAAAATTGGA
Rps1-k-1  981 AGTGTTTGCGAACCATGCGTGTCTTTCCTTGGAATCGAACGAGAACACA---ACACTAGAAAAAATTGGA
Rps1-k-5  981 AGTGTTTGCGAACCATGCGTGTCTTTCCTTGGAATCGAACGAGAACACA---ACACTAGAAAAAATTGGA
Rps1-k-2  981 AGTGTTTGCGAACCATGCATGTCTTTCCACGGAATCTAACGAGAACACAGCAACACTAGAAAAAATTGGA
Rps1-k-4  981 AGTGTTTGCGAACCATGCATGTCTTTCCACGGAATCTAACGAGAACACAGCAACACTAGAAAAAATTGGA
consensus 981 ******************.*********..******.************   ******************
```

-continued

```
Rps1-k-3   1048 AAGGAGATTGTTAAAAAGTGCGATGGACTGCCTTTAGCAGCACAGTCCCTTGGAGGCATGTTGAGAAGAA
Rps1-k-1   1048 AAGGAGATTGTTAAAAAGTGCGATGGACTGCCTTTAGCAGCACAGTCCCTTGGAGGCATGTTGAGAAGAA
Rps1-k-5   1048 AAGGAGATTGTTAAAAAGTGCGATGGACTGCCTTTAGCAGCACAGTCCCTTGGAGGCATGTTGAGAAGAA
Rps1-k-2   1051 AAGGAGATTGTTAAAAAGTGCAACGGACTGCCTTTAGCAGCAGAGTCGCTTGGAGGCATGTTGAGAAGAA
Rps1-k-4   1051 AAGGAGATTGTTAAAAAGTGCAACGGACTGCCTTTAGCAGCAGAGTCGCTTGGAGGCATGTTGAGAAGAA
consensus  1051 *********************.*.******************.****.**********************

Rps1-k-3   1118 AGCATGACATTGGGGATTGGTATAATATTCTGAATAGTGACATTTGGGAACTTTCTGAAAGTGAGTGTAA
Rps1-k-1   1118 AGCATGACATTGGGGATTGGTATAATATTCTGAATAGTGACATTTGGGAACTTTCTGAAAGTGAGTGTAA
Rps1-k-5   1118 AGCATGACATTGGGGATTGGTATAATATTCTGAATAGTGACATTTGGGAACTTTCTGAAAGTGAGTGTAA
Rps1-k-2   1121 AGCATGACATTGGTGATTGGAATAATATTCTCAATAGTGACATTTGGGAACTTTCTGAAAGTGAGTGTAA
Rps1-k-4   1121 AGCATGACATTGGTGATTGGAATAATATTCTCAATAGTGACATTTGGGAACTTTCTGAAAGTGAGTGTAA
consensus  1121 *************.******.**********.**************************************

Rps1-k-3   1188 AGTTATTCCAGCACTGAGACTTAGTTATCATTATCTCCCTCCACATTTAAAACGGTGCTTTGTTTATTGT
Rps1-k-1   1188 AGTTATTCCAGCACTGAGACTTAGTTATCATTATCTCCCTCCACATTTAAAACGGTGCTTTGTTTATTGT
Rps1-k-5   1188 AGTTATTCCAGCACTGAGACTTAGTTATCATTATCTCCCTCCACATTTAAAACGGTGCTTTGTTTATTGT
Rps1-k-2   1191 AGTTATTCCAGCACTGAGACTTAGTTATCATTATCTCCCTCCACATTTAAAACGATGCTTTGTTTATTGT
Rps1-k-4   1191 AGTTATTCCAGCACTGAGACTTAGTTATCATTATCTCCCTCCACATTTAAAACGATGCTTTGTTTATTGT
consensus  1191 ****************************************************** ***************

Rps1-k-3   1258 TCGTTGTATCCCCAAGATTACGAATTTGATAAAAATGAATTAATCTTGTTGTGGATGGCTGAAGATCTTT
Rps1-k-1   1258 TCGTTGTATCCCCAAGATTACGAATTTGATAAAAATGAATTAATCTTGTTGTGGATGGCTGAAGATCTTT
Rps1-k-5   1258 TCGTTGTATCCCCAAGATTACGAATTTGATAAAAATGAATTAATCTTGTTGTGGATGGCTGAAGATCTTT
Rps1-k-2   1261 TCGTTGTATCCACAAGATTACGAATTTGAAAAAAATGAATTAATCTTGTTGTGGATGGCTGAAGATCTTT
Rps1-k-4   1261 TCGTTGTATCCACAAGATTACGAATTTGAAAAAAATGAATTAATCTTGTTGTGGATGGCTGAAGATCTTT
consensus  1261 ***********.*****************.****************************************

Rps1-k-3   1328 TGAAGAAACCAAGGAAAGGTAGGACTTTAGAAGAGGTTGGTCATGAGTATTTTGATGATTTGGTTTCGAG
Rps1-k-1   1328 TGAAGAAACCAAGGAAAGGTAGGACTTTAGAAGAGGTTGGTCATGAGTATTTTGATGATTTGGTTTCGAG
Rps1-k-5   1328 TGAAGAAACCAAGGAAAGGTAGGACTTTAGAAGAGGTTGGTCATGAGTATTTTGATGATTTGGTTTCGAG
Rps1-k-2   1331 TGAAGAAACCAAGGAAAGGTAGGACTTTAGAAGAGGTTGGTCATGAGTATTTTGATGATTTGGTTTCGAG
Rps1-k-4   1331 TGAAGAAACCAAGGAAAGGTAGGACTTTAGAAGAGGTTGGTCATGAGTATTTTGATGATTTGGTTTCGAG
consensus  1331 **********************************************************************

Rps1-k-3   1398 ATCATTTTTCCAACGTTCAAGTACAAATAGAAGTAGTTGGCCTTATGGTGAATGTTTTGTGATGCATGAC
Rps1-k-1   1398 ATCATTTTTCCAACGTTCAAGTACAAATAGAAGTAGTTGGCCTTATGGTGAATGTTTTGTGATGCATGAC
Rps1-k-5   1401 ATCATTTTTCCAACGTTCAAGTACAAATAGAAGTAGTTGGCCTTATGGTGAATGTTTTGTGATGCATGAC
Rps1-k-2   1401 ATCGTTTTTCCAACGTTCAAGAACAA-----      GTAGTTGGCCTCATCGCAAATGTTTTGTGATGCATGAC
Rps1-k-4   1401 ATCGTTTTTCCAACGTTCAAGAACAA-----      GTAGTTGGCCTCATCGCAAATGTTTTGTGATGCATGAC
consensus  1401 ***.*****************.****.....************.**.*..********************

Rps1-k-3   1468 CTCATGCATGATCTAGCCAAATCACTCGGTGGAGATTTTTATTTAGATCAGAAGAACTTGGGAAAGAAA
Rps1-k-1   1468 CTCATGCATGATCTAGCCAAATCACTCGGTGGAGATTTTTATTTAGATCAGAAGAACTTGGGAAAGAAA
Rps1-k-5   1468 CTCATGCATGATCTAGCCAAATCACTCGGTGGAGATTTTTATTTAGATCAGAAGAACTTGGGAAAGAAA
Rps1-k-2   1465 CTCATGCATGATCTAGCCACATCACTCGGTGGAGATTTTTATTTAGATCAGAAGAACTTGGGAAAGAAA
Rps1-k-4   1465 CTCATGCATGATCTAGCCACATCACTCGGTGGAGATTTTTATTTAGATCAGAAGAACTTGGGAAAGAAA
consensus  1471 *******************.**************************************************

Rps1-k-3   1538 CAAAGATCAATACTAAGACTCGTCATTTGTCATTTACCAAATTCAATTCTTCAGTCTTGGACAACTTTGA
Rps1-k-1   1538 CAAAGATCAATACTAAGACTCGTCATTTGTCATTTACCAAATTCAATTCTTCAGTCTTGGACAACTTTGA
Rps1-k-5   1538 CAAAGATCAATACTAAGACTCGTCATTTGTCATTTACCAAATTCAATTCTTCAGTCTTGGACAACTTTGA
Rps1-k-2   1535 CAAAGATCAATACCAAGACTCGTCATTTGTCATTTGCCAAATTCAATTCTTCAGTCTTGGACAACTTTGA
Rps1-k-4   1535 CAAAGATCAATACCAAGACTCGTCATTTGTCATTTGCCAAATTCAATTCTTCAGTCTTGGACAACTTTGA
consensus  1541 *************.*********************.**********************************

Rps1-k-3   1608 TGTTGTTGGTAGAGCAAAATTTCTGAGAACTTTCTTGTCCATTATCAATTTTGAAGCTGCTCCATTCAAC
Rps1-k-1   1608 TGTTGTTGGTAGAGCAAAATTTCTGAGAACTTTCTTGTCCATTATCAATTTTGAAGCTGCTCCATTCAAC
Rps1-k-5   1608 TGTTGTTGGTAGAGCAAAATTTCTGAGAACTTTCTTGTCCATTATCAATTTTGAAGCTGCTCCATTCAAC
Rps1-k-2   1605 TGTTATTGGTAGAGCAAAATTTCTGAGAACCTTCTTGTCCATTATCAATTTTGAAGCTGCTCCATTCAAC
Rps1-k-4   1605 TGTTATTGGTAGAGCAAAATTTCTGAGAACCTTCTTGTCCATTATCAATTTTGAAGCTGCTCCATTCAAC
consensus  1611 ****.*************************.***************************************

Rps1-k-3   1678 AACGAGGAGGCACAATGTATCATTGTGTCGAAGCTTATGTACTTGAGAGTTTTATCATTTTGTGACTTCC
Rps1-k-1   1678 AACGAGGAGGCACAATGTATCATTGTGTCGAAGCTTATGTACTTGAGAGTTTTATCATTTTGTGACTTCC
Rps1-k-5   1678 AACGAGGAGGCACAATGTATCATTGTGTCGAAGCTTATGTACTTGAGAGTTTTATCATTTTGTGACTTCC
Rps1-k-2   1675 AATGAGGAGGCACAATGTATCATAATGTCGAAGCTTATGTACTTGAGAGTTTTATCATTTTGTGACTTCC
Rps1-k-4   1675 AATGAGGAGGCACAATGTATCATAATGTCGAAGCTTATGTACTTGAGAGTTTTATCATTTTGTGACTTCC
consensus  1681 **.********************..*********************************************

Rps1-k-3   1748 AAAGTTTGGATTCTTTGCCTGATTCAATAGGTAAATTGATCCATCTGCGCTATTTAGATCTTTCTCATTC
Rps1-k-1   1748 AAAGTTTGGATTCTTTGCCTGATTCAATAGGTAAATTGATCCATCTGCGCTATTTAGATCTTTCTCATTC
Rps1-k-5   1748 AAAGTTTGGATTCTTTGCCTGATTCAATAGGTAAATTGATCCATCTGCGCTATTTAGATCTTTCTCATTC
Rps1-k-2   1745 AAGTCTGGATTCTTTGCCTGATTCAATAGGTAAATTGATCCATCTGCGCTATTTAGATCTCTCTTTTTC
Rps1-k-4   1745 AAGTCTGGATTCTTTGCCTGATTCAATAGGTAAATTGATCCATCTGCGCTATTTAGATCTCTCTTTTTC
consensus  1751 ****.*******************************************************.****..***

Rps1-k-3   1818 AAGTGTAGAAACACTGCCAAAGTCATTGTGTAATTTATACAATCTGCAAACTTTGAAGTTGTGTAGTTGC
Rps1-k-1   1818 AAGTGTAGAAACACTGCCAAAGTCATTGTGTAATTTATACAATCTGCAAACTTTGAAGTTGTGTAGTTGC
Rps1-k-5   1818 AAGTGTAGAAACACTGCCAAAGTCATTGTGTAATTTATACAATCTGCAAACTTTGAAGTTGTGTAGTTGC
Rps1-k-2   1815 AAGAATAGAAACACTGCCAAAGTCATTGTGTAATTTGTACAATCTGCAAACTTTGAAGTTGTGTAGTTGC
Rps1-k-4   1815 AAGAATAGAAACACTGCCAAAGTCATTGTGTAATTTGTACAATCTGCAAACTTTGAAGTTGTGTAGTTGC
consensus  1821 ***..*******************************.*********************************

Rps1-k-3   1888 AGAAAGCTGACTAAGTTGCCTAGTGACATGTGCAATCTTGTTAACTTGCGTCATCTTGAGATACGTGAAA
Rps1-k-1   1888 AGAAAGCTGACTAAGTTGCCTAGTGACATGTGCAATCTTGTTAACTTGCGTCATCTTGAGATACGTGAAA
Rps1-k-5   1888 AGAAAGCTGACTAAGTTGCCTAGTGACATGTGCAATCTTGTTAACTTGCGTCATCTTGAGATACGTGAAA
Rps1-k-2   1885 AGAAAGCTGACTAAGTTGCCCAGTGACATGCGCAATCTTGTTAACTTGCGTCATCTTGGTATTGCTTATA
Rps1-k-4   1885 AGAAAGCTGACTAAGTTGCCCAGTGACATGCGCAATCTTGTTAACTTGCGTCATCTTGGTATTGCTTATA
consensus  1891 ********************.*********.***************************..**...*.*.*

Rps1-k-3   1958  CTCCTATAGAAGAGATGCCGAGAGGAATGAGTAAATTAAATCATCTACAACATCTGGATTTCTTTGTTGT
Rps1-k-1   1958  CTCCTATAGAAGAGATGCCGAGAGGAATGAGTAAATTAAATCATCTACAACATCTGGATTTCTTTGTTGT
Rps1-k-5   1958  CTCCTATAGAAGAGATGCCGAGAGGAATGAGTAAATTAAATCATCTACAACATCTGGATTTCTTTGTTGT
Rps1-k-2   1955 CTTCCTATAAAAGAGATGCCGAGAGGAATGGGTAAATTAAATCATTTACAACATCTGGATTTCTTTGTTGT
Rps1-k-4   1955 CTTCCTATAAAAGAGATGCCGAGAGGAATGGGTAAATTAAATCATTTACAACATCTGGATTTCTTTGTTGT
consensus  1961 *********.********************.************** *************************
```

-continued

```
Rps1-k-3   2028 GGGCAAGCACAAAGAGAATGGGATCAAAGAATTGGGAGGACTTTCAAATCTTCGTGGTCGACTTAAAATT
Rps1-k-1   2028 GGGCAAGCACAAAGAGAATGGGATCAAAGAATTGGGAGGACTTTCAAATCTTCGTGGTCGACTTAAAATT
Rps1-k-5   2028 GGGCAAGCACAAAGAGAATGGGATCAAAGAATTGGGAGGACTTTCAAATCTTCGTGGTCGACTTAAAATT
Rps1-k-2   2025 GGGCAAGCACGAAGAGAATGGAATCAAAGAATTGGGAGGACTTTCAAATCTTCGTGGTCAGCTTGAAATT
Rps1-k-4   2025 GGGCAAGCACGAAGAGAATGGAATCAAAGAATTGGGAGGACTTTCAAATCTTCGTGGTCAGCTTGAAATT
consensus  2031 **********.**********.*************************************..***.*****

Rps1-k-3   2098 AGGAACTTGGAGAATGTTTCCCAAAGTGATGAAGCGTCGGAGGCAAGGATGATGGATAAAAAACACATTA
Rps1-k-1   2098 AGGAACTTGGAGAATGTTTCCCAAAGTGATGAAGCGTCGGAGGCAAGGATGATGGATAAAAAACACATTA
Rps1-k-5   2098 AGGAACTTGGAGAATGTTTCCCAAAGTGATGAAGCGTCGGAGGCAAGGATGATGGATAAAAAACACATTA
Rps1-k-2   2095 AGGAAGTTGGAGAATGTTTCCCAAAGTGATGAAGCGTTGGAGGCAAGGATGATGGATAAAAAACACATTA
Rps1-k-4   2095 AGGAAGTTGGAGAATGTTTCCCAAAGTGATGAAGCGTTGGAGGCAAGGATGATGGATAAAAAACACATTA
consensus  2101 *****.*******************************.********************************

Rps1-k-3   2168 ATAGTTTATGGTTGGAATGGTCTAGATGTAATAACAACAGTACCAACTTCCAACTAGAAATAGATGTGCT
Rps1-k-1   2168 ATAGTTTATGGTTGGAATGGTCTAGATGTAATAACAACAGTACCAACTTCCAACTAGAAATAGATGTGCT
Rps1-k-5   2168 ATAGTTTATGGTTGGAATGGTCTAGATGTAATAACAACAGTACCAACTTCCAACTAGAAATAGATGTGCT
Rps1-k-2   2165 ATAGTTTACAGTTGGAATGGTCTGGATGTAACAACAACAGTACCAACTTCCAACTTGAAATAGATGTGCT
Rps1-k-4   2165 ATAGTTTACAGTTGGAATGGTCTGGATGTAACAACAACAGTACCAACTTCCAACTTGAAATAGATGTGCT
consensus  2171 ********..*********************.***********************.**************

Rps1-k-3   2238 TTGCAAGTTACAGCCTCACTTTAACATTGAATCGTTGAGAATAAAAGGCTATAAAGGAACCAGATTTCCA
Rps1-k-1   2238 TTGCAAGTTACAGCCTCACTTTAACATTGAATCGTTGAGAATAAAAGGCTATAAAGGAACCAGATTTCCA
Rps1-k-5   2238 TTGCAAGTTACAGCCTCACTTTAACATTGAATCGTTGAGAATAAAAGGCTATAAAGGAACCAGATTTCCA
Rps1-k-2   2235 TTGCAAGTTACAGCCTCACTTTAACATTGAATCGTTGGAAATAAAAGGTTATCAAGGAACCAGATTTCCA
Rps1-k-4   2235 TTGCAAGTTACAGCCTCACTTTAACATTGAATCGTTGGAAATAAAAGGTTATCAAGGAACCAGATTTCCA
consensus  2241 *************************************..*********.***.*****************

Rps1-k-3   2308 GATTGGATGGGAAATTCTTCCTACTGCAATATGATGAGTCTAAAATTGCGTGATTGTGACAACTGTAGTA
Rps1-k-1   2308 GATTGGATGGGAAATTCTTCCTACTGCAATATGATGAGTCTAAAATTGCGTGATTGTGACAACTGTAGTA
Rps1-k-5   2308 GATTGGATGGGAAATTCTTCCTACTGCAATATGATGAGTCTAAAATTGCGTGATTGTGACAACTGTAGTA
Rps1-k-2   2305 GATTGGATGGGAAATTCTTCCTACTGCAATATGATTAGTCTAAAATTGCGTGATTGTCACAACTGTAGTA
Rps1-k-4   2305 GATTGGATGGGAAATTCTTCCTACTGCAATATGATTAGTCTAAAATTGCGTGATTGTCACAACTGTAGTA
consensus  2311 ***********************************.*********************.************

Rps1-k-3   2378 TGCTTCCTTCACTTGGACAACTACCTTCTCTCAAGGTCCTTAAGATTGCACGATTGAATAGGCTGAAGAC
Rps1-k-1   2378 TGCTTCCTTCACTTGGACAACTACCTTCTCTCAAGGTCCTTAAGATTGCACGATTGAATAGGCTGAAGAC
Rps1-k-5   2378 TGCTTCCTTCACTTGGACAACTACCTTCTCTCAAGGTCCTTAAGATTGCACGATTGAATAGGCTGAAGAC
Rps1-k-2   2375 TGCTTCCTTCACTTGGACAACTACCTTCTCTCAAGGACCTTGGAATTGCACGATTGAATAGGCTGAAGAC
Rps1-k-4   2375 TGCTTCCTTCACTTGGACAACTACCTTCTCTCAAGGACCTTGGAATTGCACGATTGAATAGGCTGAAGAC
consensus  2381 ************************************.****...**************************

Rps1-k-3   2448 TATTGATGCAGGTTTTTACAAGAACGAAGATTGTCGTTCTGGGACGCCCTTTCCCTCCCTTGAATCTCTG
Rps1-k-1   2448 TATTGATGCAGGTTTTTACAAGAACGAAGATTGTCGTTCTGGGACGCCCTTTCCCTCCCTTGAATCTCTG
Rps1-k-5   2448 TATTGATGCAGGTTTTTACAAGAACGAAGATTGTCGTTCTGGGACGCCCTTTCCCTCCCTTGAATCTCTG
Rps1-k-2   2445 TATTGATGCAGGTTTCTACAAGAATGAAGAATGTCGTTCTGGGACGTCCTTTCCCTCCCTTGAATCTCTG
Rps1-k-4   2445 TATTGATGCAGGTTTCTACAAGAATGAAGAATGTCGTTCTGGGACGTCCTTTCCCTCCCTTGAATCTCTG
consensus  2451 ***************.********.*****.***************.***********************

Rps1-k-3   2518 GCCATTCATCAAATGCCTTGTTGGGAGGTGTGGAGTTCCTTCGATTCAGAAGCTTTTCCTGTGCTTGAAA
Rps1-k-1   2518 GCCATTCATCAAATGCCTTGTTGGGAGGTGTGGAGTTCCTTCGATTCAGAAGCTTTTCCTGTGCTTGAAA
Rps1-k-5   2518 GCCATTCATCAAATGCCTTGTTGGGAGGTGTGGAGTTCCTTCGATTCAGAAGCTTTTCCTGTGCTTGAAA
Rps1-k-2   2515 TCCATTGATGACATGCCTTGTTGGGAGGTGTGGAGTTCCTTCGATTCAGAAGCTTTTCCTGTGCTTAACA
Rps1-k-4   2515 TCCATTGATGACATGCCTTGTTGGGAGGTGTGGAGTTCCTTCGATTCAGAAGCTTTTCCTGTGCTTAACA
consensus  2521 .*****.**.*.******************************************************.*.*

Rps1-k-3   2588 TTCTTGAAATACGTGACTGCCCCAAACTAGAGGGAAGTTTGCCGAATCACCTTCCTGCTCTGAAAACACT
Rps1-k-1   2588 TTCTTGAAATACGTGACTGCCCCAAACTAGAGGGAAGTTTGCCGAATCACCTTCCTGCTCTGAAAACACT
Rps1-k-5   2588 TTCTTGAAATACGTGACTGCCCCAAACTAGAGGGAAGTTTGCCGAATCACCTTCCTGCTCTGAAAACACT
Rps1-k-2   2885 GTCTTGAAATACGTGACTGCCCCAAACTAGAGGGAAGTTTGCCGAATCACCTTCCTGCTCTGACAAAACT
Rps1-k-4   2885 GTCTTGAAATACGTGACTGCCCCAAACTAGAGGGAAGTTTGCCGAATCACCTTCCTGCTCTGACAAAACT
consensus  2591 .**************************************************************.**.***

Rps1-k-3   2658 TACAATTAGAAATTGTGAGCTGCTTGGCTCTTCTCTCCCAACGGCTCCCGCCATTCAAAGTTTGGAGATA
Rps1-k-1   2658 TACAATTAGAAATTGTGAGCTGCTTGGCTCTTCTCTCCCAACGGCTCCCGCCATTCAAAGTTTGGAGATA
Rps1-k-5   2658 TACAATTAGAAATTGTGAGCTGCTTGGCTCTTCTCTCCCAACGGCTCCCGCCATTCAAAGTTTGGAGATA
Rps1-k-2   2655 TGTGATTAGAAATTGCGAGCTGCTTGTCTCTTCTCTCCCAACGGCTCCCGCCATTCAAAGTTTGGAGATA
Rps1-k-4   2655 TGTGATTAGAAATTGCGAGCTGCTTGTCTCTTCTCTCCCAACGGCTCCCGCCATTCAAAGTTTGGAGATA
consensus  2661 *...***********.**********.*******************************************

Rps1-k-3   2728 CGTAAAAGCAATAAAGTAGCACTGCATGCGTTTCCTCTCTTGGTAGAAACTATAAAAGTAGAAGGAAGCC
Rps1-k-1   2728 CGTAAAAGCAATAAAGTAGCACTGCATGCGTTTCCTCTCTTGGTAGAAACTATAAAAGTAGAAGGAAGCC
Rps1-k-5   2728 CGTAAAAGCAATAAAGTAGCACTGCATGCGTTTCCTCTCTTGGTAGAAACTATAAAAGTAGAAGGAAGCC
Rps1-k-2   2725 TGTAAAAGCAATAAAGTAGCACTGCATGCGTTTCCTCTCTTGGTAGAAACTATAGAAGTAGAAGGAAGCC
Rps1-k-4   2725 TGTAAAAGCAATAAAGTAGCACTGCATGCGTTTCCTCTCTTGGTAGAAACTATAGAAGTAGAAGGAAGCC
consensus  2731 .*****************************************************.***************

Rps1-k-3   2798 CAATGGTGGAGTCCATGATGGAGGCCATCACAAACATCCAACCAACTTGTCTCCGGTCTTTAACATTAAG
Rps1-k-1   2798 CAATGGTGGAGTCCATGATGGAGGCCATCACAAACATCCAACCAACTTGTCTCCGGTCTTTAACATTAAG
Rps1-k-5   2798 CAATGGTGGAGTCCATGATGGAGGCCATCACAAACATCCAACCAACTTGTCTCCGGTCTTTAACATTAAG
Rps1-k-2   2795 CAATGGTGGAGTCCGTGATCGAGGCCATCACTAACATCCAACCAACTTGTCTCCGGTCTTTAACATTAAG
Rps1-k-4   2795 CAATGGTGGAGTCCGTGATCGAGGCCATCACTAACATCCAACCAACTTGTCTCCGGTCTTTAACATTAAG
consensus  2801 **************.****.***********.**************************************

Rps1-k-3   2868 GGATTGCTCGTCAGCCGTGTCATTTCCGGGTGGTCGTTTACCTGAATCACTGAAGAGTCTGTATATCTCG
Rps1-k-1   2868 GGATTGCTCGTCAGCCGTGTCATTTCCGGGTGGTCGTTTACCTGAATCACTGAAGAGTCTGTATATCTCG
Rps1-k-5   2868 GGATTGCTCGTCAGCCGTGTCATTTCCGGGTGGTCGTTTACCTGAATCACTGAAGAGTCTGTATATCTCG
Rps1-k-2   2865 GGATTGTTCGTCAGCCGTGTCATTTCCGGGTGGTCGTTTACCTGAATCACTGAAGAGTCTGAGTATCAAG
Rps1-k-4   2865 GGATTGTTCGTCAGCCGTGTCATTTCCGGGTGGTCGTTTACCTGAATCACTGAAGAGTCTGAGTATCAAG
consensus  2871 ******.******************************************************..****..*

Rps1-k-3   2938 GATCTTAAAAAACTGGAATTCCCGACGCAACACAAACATGAGTTACTGGAAACACTGTCAATAGAAAGCA
Rps1-k-1   2938 GATCTTAAAAAACTGGAATTCCCGACGCAACACAAACATGAGTTACTGGAAACACTGTCAATAGAAAGCA
Rps1-k-5   2938 GATCTTAAAAAACTGGAATTCCCGACGCAACACAAACATGAGTTACTGGAAACACTGTCAATAGAAAGCA
Rps1-k-2   2935 GATCTTAAAAAACTGGAATTCCCGACGCAACACAAACATGAGTTACTGGAAACACTGTCAATAGAAAGCA
Rps1-k-4   2935 GATCTTAAAAAACTGGAATTCCCGACGCAACACAAACATGAGTTACTGGAAACACTGTCAATAGAAAGCA
consensus  2941 **********************************************************************
```

-continued

```
Rps1-k-3   3008 GTTGTGATTCACTCACATCTCTTCCATTGGTTACCTTTCCAAATCTCAGAGATCTTGAAATCAGAAACTG
Rps1-k-1   3008 GTTGTGATTCACTCACATCTCTTCCATTGGTTACCTTTCCAAATCTCAGAGATCTTGAAATCAGAAACTG
Rps1-k-5   3008 GTTGTGATTCACTCACATCTCTTCCATTGGTTACCTTTCCAAATCTCAGAGATCTTGAAATCAGAAACTG
Rps1-k-2   3005 GTTGTGATTCACTCACATCTCTTCCATTGGTTACCTTTCCAAATCTCAGATATCTCAGCATCGAAAAGTG
Rps1-k-4   3005 GTTGTGATTCACTCACATCTCTTCCATTGGTTACCTTTCCAAATCTCAGATATCTCAGCATCGAAAAGTG
consensus  3011 **************************************************.****....***..***.**

Rps1-k-3   3078 TGAAAATATGGAATCTCTTTTGGT----------------------------------------------
Rps1-k-1   3078 TGAAAATATGGAATCTCTTTTGGT----------------------------------------------
Rps1-k-5   3078 TGAAAATATGGAATCTCTTTTGGT----------------------------------------------
Rps1-k-2   3075 TGAAAATATGGAATATCTTTTGGTTTCAGGGGCAGAGTCATTTAAGAGTCTGTGTTATTTGTTAATTTAC
Rps1-k-4   3075 TGAAAATATGGAATATCTTTTGGTTTCAGGGGCAGAGTCATTTAAGAGTCTGTGTTATTTGTTAATTTAC
consensus  3081 **************.*******************************************************

Rps1-k-3   3102 -----------------ATCATTCTGGAGAGAAGGATTGCCTGCGCCCAACTTGATTACTTTCCAAGTGT
Rps1-k-1   3102 -----------------ATCATTCTGGAGAGAAGGATTGCCTGCGCCCAACTTGATTACTTTCCAAGTGT
Rps1-k-5   3102 -----------------ATCATTCTGGAGAGAAGGATTGCCTGCGCCCAACTTGATTACTTTCCAAGTGT
Rps1-k-2   3145 AAATGCCCCAACTTTGTATCATTCTGGAGAGAAGGATTGCCTGCGCCCAACTTGATTACTTTGAGTGTTT
Rps1-k-4   3145 AAATGCCCCAACTTTGTATCATTCTGGAGAGAAGGATTGCCTGCGCCCAACTTGATTACTTTGAGTGTTT
consensus  3151 ***************************************************************...**.*

Rps1-k-3   3155 GGGGCTCTGACAAGTTGAAGTCGTTGCCTGATGAGATGAGTACTCTTCTCCCAAAGTTAGAACGTCTCCT
Rps1-k-1   3155 GGGGCTCTGACAAGTTGAAGTCGTTGCCTGATGAGATGAGTACTCTTCTCCCAAAGTTAGAACGTCTCCT
Rps1-k-5   3155 GGGGCTCTGACAAGTTGAAGTCGTTGCCTGATGAGATGAGTACTCTTCTCCCAAAGTTAGAACGTCTCCT
Rps1-k-2   3215 GGGGCTCTGACAAGTTGAAGTCGTTGCCTGATGAGATGAGTACTCTTCTCCCAAAGTTAGAAGATCTCAC
Rps1-k-4   3215 GGGGCTCTGACAAGTTGAAGTCGTTGCCTGATGAGATGAGTACTCTTCTCCCAAAGTTAGAAGATCTCAC
consensus  3221 **************************************************************..****..

Rps1-k-3   3225 CATATCCAACTGCCCAGAAATTGAGTCGTTTCCAAAACGGGGTATGCCACCTAACCTGAGAATAGTTTGG
Rps1-k-1   3225 CATATCCAACTGCCCAGAAATTGAGTCGTTTCCAAAACGGGGTATGCCACCTAACCTGAGAATAGTTTGG
Rps1-k-5   3225 CATATCCAACTGCCCAGAAATTGAGTCGTTTCCAAAACGGGGTATGCCACCTAACCTGAGAATAGTTTGG
Rps1-k-2   3285 CATATCCAACTGCCCAGAAATTGAGTCCTTTCCAAAACGGGGTATGCCACCTAACCTGAGAAGAGTTGAG
Rps1-k-4   3285 CATATCCAACTGCCCAGAAATTGAGTCCTTTCCAAAACGGGGTATGCCACCTAACCTGAGAAGAGTTGAG
consensus  3291 ***************************.**********************************.****..*

Rps1-k-3   3295 ATTTTCAATTGTGAGAAACTACTGAGCAGCCTAGCATGGCCATCCATGGGCATGCTTACTCATCTCTATG
Rps1-k-1   3295 ATTTTCAATTGTGAGAAACTACTGAGCAGCCTAGCATGGCCATCCATGGGCATGCTTACTCATCTCTATG
Rps1-k-5   3295 ATTTTCAATTGTGAGAAACTACTGAGCAGCCTAGCATGGCCATCCATGGGCATGCTTACTCATCTCTATG
Rps1-k-2   3355 ATTGTCAATTGTGAGAAACTACTGAGCGGCCTAGCATGGCCATCCATGGGCATGCTTACTCATCTCAATG
Rps1-k-4   3355 ATTGTCAATTGTGAGAAACTACTGAGCGGCCTAGCATGGCCATCCATGGGCATGCTTACTCATCTCAATG
consensus  3361 ***.***********************.**************************************.***

Rps1-k-3   3365 TTGGGGGTCGATGTGATGGCATCAAGTCCTTCCCTAAGGAGGGTTTGCTGCCTCCCTCCCTTACGTATCT
Rps1-k-1   3365 TTGGGGGTCGATGTGATGGCATCAAGTCCTTCCCTAAGGAGGGTTTGCTGCCTCCCTCCCTTACGTATCT
Rps1-k-5   3365 TTGGGGGTCGATGTGATGGCATCAAGTCCTTCCCTAAGGAGGGTTTGCTGCCTCCCTCCCTTACGTATCT
Rps1-k-2   3425 TTGGGGGTCCATGTGATGGCATCAAGTCCTTCCCTAAAGAGGGTTTGCTGCCTCCCTCCCTTACGTCTCT
Rps1-k-4   3425 TTGGGGGTCCATGTGATGGCATCAAGTCCTTCCCTAAAGAGGGTTTGCTGCCTCCCTCCCTTACGTCTCT
consensus  3431 *********.***************************.****************************.***

Rps1-k-3   3435 GTATCTAAGTGGATTCTCAAATCTGGAGATGTTGGACTGCACGGGGCTTCTCCATCTCACATCCCTGCAA
Rps1-k-1   3435 GTATCTAAGTGGATTCTCAAATCTGGAGATGTTGGACTGCACGGGGCTTCTCCATCTCACATCCCTGCAA
Rps1-k-5   3435 GTATCTAAGTGGATTCTCAAATCTGGAGATGTTGGACTGCACGGGGCTTCTCCATCTCACATCCCTGCAA
Rps1-k-2   3495 GTCTCTATATGACTTGTCAAATCTGGAGATGTTGGACTGCACGGGGCTTCTCCATCTCACATCCCTGCAA
Rps1-k-4   3405 GTCTCTATATGACTTGTCAAATCTGGAGATGTTGGACTGCACGGGGCTTCTCCATCTCACATCCCTGCAA
consensus  3501 **.****..**..**.******************************************************

Rps1-k-3   3505 CAATTAACCATAGACGGATGTCCTTTGCTGGAAAATATGGTGGGAGAAAGGCTTCCTGACTCTCTAATAA
Rps1-k-1   3505 CAATTAACCATAGACGGATGTCCTTTGCTGGAAAATATGGTGGGAGAAAGGCTTCCTGACTCTCTAATAA
Rps1-k-5   3505 CAATTAACCATAGACGGATGTCCTTTGCTGGAAAATATGGTGGGAGAAAGGCTTCCTGACTCTCTAATAA
Rps1-k-2   3565 CAATTACAAATTTTTGGATGTCCAAAGCTGGAGAATATGGCTGGAGAAAGTCTTCCTTTCTCTCTAATAA
Rps1-k-4   3565 CAATTACAAATTTTTGGATGTCCAAAGCTGGAGAATATGGCTGGAGAAAGTCTTCCTTTCTCTCTAATAA
consensus  3571 ******...**....********...******.*******..********.******..***********

Rps1-k-3   3575 AATTAACCATAAAGAGTTGTCCTTTGCTGAAAAAACGATGCCGGAAGAAGCACCCTCAAATTTGGCCTAA
Rps1-k-1   3575 AATTAACCATAAAGAGTTGTCCTTTGCTGAAAAAACGATGCCGGAAGAAGCACCCTCAAATTTGGCCTAA
Rps1-k-5   3575 AATTAACCATAAAGAGTTGTCCTTTGCTGAAAAAACGATGCCGGAAGAAGCACCCTCAAATTTGGCCTAA
Rps1-k-2   3635 AATTAACCATGGTGGAATGTCCTTTGCTGGAAAAACGATGCCGCATGAAGCACCCTCAAATTTGGCCTAA
Rps1-k-4   3635 AATTAACCATGGTGGAATGTCCTTTGCTGGAAAAACGATGCCGCATGAAGCACCCTCAAATTTGGCCTAA
consensus  3641 **********...*...************.*************.*.************************

Rps1-k-3   3645 AATTTCCCACATCCCTGGCATTAAGGTTGACAATAGATGGATTTAG  (SEQ ID NO:1)
Rps1-k-1   3645 AATTTCCCACATCCCTGGCATTAAGGTTGACAATAGATGGATTTAG  (SEQ ID NO:6)
Rps1-k-5   3645 AATTTCCCACATCCCTGGCATTAAGGTTGACAATAGATGGATTTAG  (SEQ ID NO:2)
Rps1-k-2   3705 AGTTTCCCACATCCCTGGCATTAAGGTTGGCAATAGATGGATTTAG  (SEQ ID NO:7)
Rps1-k-4   3705 AGTTTCCCACATCCCTGGCATTAAGGTTGGCAATAGATGGATTTAG  (SEQ ID NO:3)
consensus  3711 *.***************************.****************
```

Sequence alignment of 3′ ends

```
Rps1-k-2_3end   1 TAGCCACCAAGGAGGACCAACAGGTATCTTCTAAGTCTAACCAACTAGAAAACTATTTCTGTCAAGGATA
Rps1-k-4_3end   1 TAGCCACCAAGGAGGACCAACAGGTATCTTCTAAGTCTAACCAACTAGAAAACTATTTCTGTCAAGGATA
Rps1-k-3_3end   1 TAGCCACCAAGGAGGACCAACAGGTATCTTCTAAGTCTAACCAACTAGAAAACTAGTTCTGTCAAGGATA
Rps1-k-5_3end   1 TAGCCACCAAGGAGGACCAACAGGTATCTTCTAAGTCTAACCAACTAGAAAACTAGTTCTGTCAAGGATA
Rps1-k-1_3end   1 TAGCCACCAAGGAGGACCAACAGGTATCTTCTAAGTCTAACCAACTAGAAAACTAGTTCTGTCAAGGATA
consensus       1 *******************************************************.**************

Rps1-k-2_3end  71 TGTTTCATTTCATGTCTTTCTACTTTTACGTTTTACTAAATCCAATTCATTCTGAAATGGAAATTGACCT
Rps1-k-4_3end  71 TGTTTCATTTCATGTCTTTCTACTTTTACGTTTTACTAAATCCAATTCATTCTGAAATGGAAATTGACCT
Rps1-k-3_3end  71 TGTTTCATTTCATGTCTTTCTCCTTTTACGTTTTACTAAATCCAATTCATTCTGAAATGGAAATTGACCT
Rps1-k-5_3end  71 TGTTTCATTTCATGTCTTTCTCCTTTTACGTTTTACTAAATCCAATTCATTCTGAAATGGAAATTGACCT
Rps1-k-1_3end  71 TGTTTCATTTCATGTCTTTCTCCTTTTACGTTTTACTAAATCCAATTCATTCTGAAATGGAAATTGACCT
consensus      71 *********************.************************************************
```

-continued

```
Rps1-k-2_3end 141 TGTATATATGTTACTGAATCTACAGAGAATCAACAAATCATCAAAGGCAACGTGGAAATTGACCTTGTAT
Rps1-k-4_3end 141 TGTATATATGTTACTGAATCTACAGAGAATCAACAAATCATCAAAGGCAACGTGGAAATTGACCTTGTAT
Rps1-k-3_3end 141 TGTATATATGTTACTGAATCTACAGAGAATCAACAAATCATCAAAGGCAACGTGGAAATTGACCTTGTAT
Rps1-k-5_3end 141 TGTATATATGTTACTGAATCTACAGAGAATCAACAAATCATCAAAGGCAACGTGGAAATTGACCTTGTAT
Rps1-k-1_3end 141 TGTATATATGTTACTGAATCTACAGAGAATCAACAAATCATCAAAGGCAACGTGGAAATTGACCTTGTAT
consensus     141 **********************************************************************

Rps1-k-2_3end 211 ATATGTTTCGAAGAAGTAACGATACAGGTACTAAGTAACAACATTGACAAATACTTAAATATAATGATTC
Rps1-k-4_3end 211 ATATGTTTCGAAGAAGTAACGATACAGGTACTAAGTAACAACATTGACAAATACTTAAATATAATGATTC
Rps1-k-3_3end 211 ATATGTTTCGAAGAAGTAACGATACAGGTACTAAGTAACAACATTGATAAATACTTAAATATAATGATTC
Rps1-k-5_3end 211 ATATGTTTCGAAGAAGTAACGATACAGGTACTAAGTAACAACATTGATAAATACTTAAATATAATGATTC
Rps1-k-1_3end 211 ATATGTTTCGAAGAAGTAACGATACAGGTACTAAGTAACAACATTGATAAATACTTAAATATAATGATTC
consensus     211 ***********************************************.**********************

Rps1-k-2_3end 281 TCCGGAAAAATGTTACACATCAGTGTTGTTATATTCTAACTTAATTTCTCCTTAAGATTATTGAGGCCAG
Rps1-k-4_3end 281 TCCGGAAAAATGTTACACATCAGTGTTGTTATATTCTAACTTAATTTCTCCTTAAGATTATTGAGGCCAG
Rps1-k-3_3end 281 TCCGGAAAAATGTTACACATCAGTATTGTTATATTCTAACTTAATTTCTCCTTAAGATTATTGAGGCCAG
Rps1-k-5_3end 281 TCCGGAAAAATGTTACACATCAGTATTGTTATATTCTAACTTAATTTCTCCTTAAGATTATTGAGGCCAG
Rps1-k-1_3end 281 TCCGGAAAAATGTTACACATCAGTATTGTTATATTCTAACTTAATTTCTCCTTAAGATTATTGAGGCCAG
consensus     281 ************************.*********************************************

Rps1-k-2_3end 351 AGTGAAAATGACCGTGGGAAACTTATTTTTGTTTTTCAGATATGGTTGATTGGCCCGGAGAAACTGTACC
Rps1-k-4_3end 351 AGTGAAAATGACCGTGGGAAACTTATTTTTGTTTTTCAGATATGGTTGATTGGCCCGGAGAAACTGTACC
Rps1-k-3_3end 351 AGTGAAAATGACCGTGGGAAACTTATTTTTGTTTTTCAGATATGGTTGATTGGCCCGGAGAAACTGTACC
Rps1-k-5_3end 351 AGTGAAAATGACCGTGGGAAACTTATTTTTGTTTTTCAGATATGGTTGATTGGCCCGGAGAAACTGTACC
Rps1-k-1_3end 351 AGTGAAAATGACCGTGGGAAACTTATTTTTGTTTTTCAGATATGGTTGATTGGCCCGGAGAAACTGTACC
consensus     351 **********************************************************************

Rps1-k-2_3end 421 TACCCATGAATCTAAGTTCAAATTTGAACTAGTGCTAAATGTAACTTTTAATTTAATTGATGTCAAATTG
Rps1-k-4_3end 421 TACCCATGAATCTAAGTTCAAATTTGAACTAGTGCTAAATGTAACTTTTAATTTAATTGATGTCAAATTG
Rps1-k-3_3end 421 TACCCATGAATCTAAGTTCAAATTTGAACTAGTGCTAAATGTAACTTTTAATTTAATTGATGTCAAATTG
Rps1-k-5_3end 421 TACCCATGAATCTAAGTTCAAATTTGAACTAGTGCTAAATGTAACTTTTAATTTAATTGACGTCAAATTG
Rps1-k-1_3end 421 TACCCATGAATCTAAGTTCAAATTTGAACTAGTGCTAAATGTAACTTTTAATTTAATTGACGTCAAATTG
consensus     421 ************************************************************.*********

Rps1-k-2_3end 491 ACACTTTCTCAATAGCTGAATTTTTATTTGTGAGGTTTTTCGTTGGGTACAATGTGAAGGATGAAAAGGT
Rps1-k-4_3end 491 ACACTTTCTCAATAGCTGAATTTTTATTTGTGAGGTTTTTCGTTGGGTACAATGTGAAGGATGAAAAGGT
Rps1-k-3_3end 491 ACACTTTCTCAATAGCTGAATTTTTATTTGTGAGGTTTTTCGTTGGGTACAATGTGAAGGATGAAAAGGT
Rps1-k-5_3end 491 ACACTTTCTCAATAGCTAAATTTTTATTTGTGAGGTTTTTTGTTAGGTACAATGTGAAGGATGAAAAGGT
Rps1-k-1_3end 491 ACACTTTCTCAATAGCTAAATTTTTATTTGTGAGGTTTTTTGTTAGGTACAATGTGAAGGATGAAAAGGT
consensus     491 *****************.**********************.***.*************************

Rps1-k-2_3end 561 GTACCAAGTGAACTTTAGAAGGATTGGATGATTTCAGCTTATCTCTTATTCCCTGTCCTATAAATTAATA
Rps1-k-4_3end 561 GTACCAAGTGAACTTTAGAAGGATTGGATGATTTCAGCTTATCTCTTATTCCCTGTCCTATAAATTAATA
Rps1-k-3_3end 561 GTACCAAGTGAACTTTAGAAGGATTGGATGATTTCAGCTTATCTCTTATTCCCTGTCCTATAAATTAATA
Rps1-k-5_3end 561 GTACCAAGTGAACTTTAGAAGGATTGGATGATTTCAGCTTATCTCTTATCTCCTGTCCTATAAATTAATA
Rps1-k-1_3end 561 GTACCAAGTGAACTTTAGAAGGATTGGATGATTTCAGCTTATCTCTTATCTCCTGTCCTATAAATTAATA
consensus     561 *************************************************..*******************

Rps1-k-2_3end 631 ATGGTATGATTATTCTAAAAATATGATAGATATGTAGATAAGTAAGAATTGATAAAAGCATAATAAATAT
Rps1-k-4_3end 631 ATGGTATGATTATTCTAAAAATATGATAGATATGTAGATAAGTAAGAATTGATAAAAGCATAATAAATAT
Rps1-k-3_3end 631 ATGGTATGATTATTCTAAAAATATGATAGATATGTAGATAAGTAAGAATTGATAAAAGCATAATAAATAT
Rps1-k-5_3end 631 GTGGTATGATTATTCTAAAAATATGATAGATATGTAGATACGTAAGAATTGATAAAAGCATAATAAATAT
Rps1-k-1_3end 631 GTGGTATGATTATTCTAAAAATATGATAGATATGTAGATACGTAAGAATTGATAAAAGCATAATAAATAT
consensus     631 ****************************************.*****************************

Rps1-k-2_3end 701 ACAATTGCAATTCGGTAAACTGAAGAACATACATACTTCTTAGACATTGCTAAAAACAAAATCAAAAAAT
Rps1-k-4_3end 701 ACAATTGCAATTCGGTAAACTGAAGAACATACATACTTCTTAGACATTGCTAAAAACAAAATCAAAAAAT
Rps1-k-3_3end 701 ACAATTGCAATTCGGTAAACTGAAGAACATACATACTTCTTAGACATTGCTAAAAACAAAATCAAAAAAT
Rps1-k-5_3end 701 ACAATTGCAATTCGGTAAATTGAAGAACATACATACTTCTTAGACATTGCTAAAAACAAAATCAAAAAAT
Rps1-k-1_3end 701 ACAATTGCAATTCGGTAAATTGAAGAACATACATACTTCTTAGACATTGCTAAAAACAAAATCAAAAAAT
consensus     701 *******************.**************************************************

Rps1-k-2_3end 771 TGTAGATCATTTTTTTCCTATTGTTCACAAATAAGAATGGTACTATCAATGATCAATCTCATTTCTTTCT
Rps1-k-4_3end 771 TGTAGATCATTTTTTTCCTATTGTTCACAAATAAGAATGGTACTATCAATGATCAATCTCATTTCTTTCT
Rps1-k-3_3end 771 TGTAGATCATTTTTTTCCTATTGTTCACAAATAAGAATGGTACTATCAATGATCAATCTCATTTCTTTCT
Rps1-k-5_3end 771 TGTAGATCATTTTTT-CCTATTGTTCACAAATAAGAATGGTACTATCAATGATCAATCTCATTTCTTTCT
Rps1-k-1_3end 771 TGTAGATCATTTTTT-CCTATTGTTCACAAATAAGAATGGTACTATCAATGATCAATCTCATTTCTTTCT
consensus     771 ***************.******************************************

Rps1-k-2_3end 841 TGAAATTATCTATAAACAAAACAATTTTCATATT-GGTTCATCAAGAAACAATACTTTTTATATTTCTAT
Rps1-k-4_3end 841 TGAAATTATCTATAAACAAAACAATTTTCATATT-GGTTCATCAAGAAACAATACTTTTTATATTTCTAT
Rps1-k-3_3end 841 TGAAATTATCTATAAACAAAACAATTTTCATATT-GGTTCATCAAGAAACAATACTTTTTATATTTCTAT
Rps1-k-5_3end 840 TGAAATTATCTATAAACAAAACAATTTTCATATTTGGTTCATCAAGAAACAATACTTTTTATATTTCTAT
Rps1-k-1_3end 840 TGAAATTATCTATAAACAAAACAATTTTCATATTTGGTTCATCAAGAAACAATACTTTTTATATTTCTAT
consensus     841 ********************************** ***********************************

Rps1-k-2_3end 910 ATTATACTTACTTCTATGTTACATGTCACTATATTTGATTATCATAATTTTTTTTTAAA-GAATTGGTCA
Rps1-k-4_3end 910 ATTATACTTACTTCTATGTTACATGTCACTATATTTGATTATCATAATTTTTTTTTAAA-GAATTGGTCA
Rps1-k-3_3end 910 ATTATACTTACTTCTATGTTACATGTCACTATATTTGATTATCATAATTTTTTTTTAAA-GAATTGGTCA
Rps1-k-5_3end 910 ATTATATTTACTTCTATGTTACATGTCACTATATTTGATTATCATAATTTTTTTTTAAAAGAATTGGTCA
Rps1-k-1_3end 910 ATTATATTTACTTCTATGTTACATGTCACTATATTTGATTATCATAATTTTTTTTTAAAAGAATTGGTCA
consensus     911 ******.**************************************************** **********

Rps1-k-2_3end 979 CTTCACATATATGTATCAG------------ATATATTGGTATCAGATATAGATGCATGAAGCAAATTAA
Rps1-k-4_3end 979 CTTCACATATATGTATCAG------------ATATATTGGTATCAGATATAGATGCATGAAGCAAATTAA
Rps1-k-3_3end 979 CTTCACATATATGTATCAG------------ATATATTGGTATCAGATATAGATGCATGAAGCAAATTAA
Rps1-k-5_3end 980 CTTTACATATATGTACCAGTGAAATATATCAATATATTGGTATCGGATATAGATGCATGAAGCAAATTAA
Rps1-k-1_3end 980 CTTTACATATATGTACCAGTGAAATATATCAATATATTGGTATCGGATATAGATGCATGAAGCAAATTAA
consensus     981 ***.***********.***            *************.*************************

Rps1-k-2_3end 1037 AGTATCAGTACTTTGTAGCAAAACACATTCTTCAAATCATGACATGAGGTAAAAAAAAATAAGATGATAT
Rps1-k-4_3end 1037 AGTATCAGTACTTTGTAGCAAAACACATTCTTCAAATCATGACATGAGGTAAAAAAAAATAAGATGATAT
Rps1-k-3_3end 1037 AGTATCAGTACTTTGTAGCAAAACACATTCTTCAAATCATGACATGAGGTAAAAAAAAATAAGATGATAT
Rps1-k-5_3end 1050 AGTATCAGTACTTTGTAGCAAAACACATTCTTCAAATCATGACATGAGGTAAAAAAATAT--GATGATAT
Rps1-k-1_3end 1050 AGTATCAGTACTTTGTAGCAAAACACATTCTTCAAATCATGACATGAGGTAAAAAAATAT--GATGATAT
consensus     1051 *********************************************************.**..********
```

-continued

```
Rps1-k-2_3end 1107 TTTTGTAAGTATTGGAAAAAAAAAGA---GTAAAGCTTCTGAAATCAAAGAGACACTAATTTTCCACAAC
Rps1-k-4_3end 1107 TTTTGTAAGTATTGGAAAAAAAAAGA---GTAAAGCTTCTGAAATCAAAGAGACACTAATTTTCCACAAC
Rps1-k-3_3end 1107 TTTTGTAAGTATTGGAAAAAAAAAGA---GTAAAGCTTCTGAAATCAAAGAGACACTAATTTTCCACAAC
Rps1-k-5_3end 1118 TTTTGTAAGTATTGGAAAAAAAAAAAAAAGTAAAGCTTCTGAAATCAAAGAGACACTAATTTTCCACAAC
Rps1-k-1_3end 1118 TTTTGTAAGTATTGGAAAAAAAAAAAAAAGTAAAGCTTCTGAAATCAAAGAGACACTAATTTTCCACAAC
consensus     1121 ************************.*   *****************************************

Rps1-k-2_3end 1174 ATCCTTCAATTGGGCCCAAGCTTCCTTTCCTATGGACAAATAACTGGTTGTTAGTGCCAGCCTTTTCTTT
Rps1-k-4_3end 1174 ATCCTTCAATTGGGCCCAAGCTTCCTTTCCTATGGACAAATAACTGGTTGTTAGTGCCAGCCTTTTCTTT
Rps1-k-3_3end 1174 ATCCTTCAATTGGGCCCAAGCTTCCTTTCCTATGGACAAATAACTGGTTGTTAGTGCCAGCCTTTTCTTT
Rps1-k-5_3end 1188 ATCCTTCAATTGGGCCCAAGCTTCCTTTCCTATTGACAAATAACTGGTTGTTAGTGCCAGCTTTTTCTTT
Rps1-k-1_3end 1188 ATCCTTCAATTGGGCCCAAGCTTCCTTTCCTATTGACAAATAACTGGTTGTTAGTGCCAGCTTTTTCTTT
consensus     1191 *********************************.***************************.********

Rps1-k-2_3end 1244 TTACCAGTTTTCCATTGATGGTTAAAAGCTATTATGAACCTGTCACTCCTTAAAATTTCCACCAAAGTTT
Rps1-k-4_3end 1244 TTACCAGTTTTCCATTGATGGTTAAAAGCTATTATGAACCTGTCACTCCTTAAAATTTCCACCAAAGTTT
Rps1-k-3_3end 1244 TTACCAGTTTTCCATTGATGGTTAAAAGCTATTATGAACCTGTCACTCCTTAAAATTTCCACCAAAGTTT
Rps1-k-5_3end 1258 TTTCTAGTTTTCCATTGATGGTTAAAAGCTAATATGAACCTGTCACTCCTTAAAATTTCCACCAAAGTTT
Rps1-k-1_3end 1258 TTTCTAGTTTTCCATTGATGGTTAAAAGCTAATATGAACCTGTCACTCCTTAAAATTTCCACCAAAGTTT
consensus     1261 **.*.**************************.*************************

Rps1-k-2_3end 1314 GGTAAATAAATATATAGGAGAGTGAATAATACAAGTCTTGCATTCTATCTCTAAGTTATTAGGTATATGA
Rps1-k-4_3end 1314 GGTAAATAAATATATAGGAGAGTGAATAATACAAGTCTTGCATTCTATCTCTAAGTTATTAGGTATATGA
Rps1-k-3_3end 1314 GGTAAATAAATATATAGGAGAGTGAATAATACAAGTCTTGCATTCTATCTCTAAGTTATTAGGTATATGA
Rps1-k-5_3end 1328 GGTAAATAAATATATAGGAGAGTGAATAATGCAAGCCTTGCATTCTATCTCTAAGTTACTAGGTATATGA
Rps1-k-1_3end 1328 GGTAAATAAATATATAGGAGAGTGAATAATGCAAGCCTTGCATTCTATCTCTAAGTTACTAGGTATATGA
consensus     1331 ******************************.****.***********************.**********

Rps1-k-2_3end 1384 AACAGGTATGGGTATTTGGTTTTAGAAGGTATGTGGTTCATCACTATTTATATTATTACTACAAGAACCA
Rps1-k-4_3end 1384 AACAGGTATGGGTATTTGGTTTTAGAAGGTATGTGGTTCATCACTATTTATATTATTACTACAAGAACCA
Rps1-k-3_3end 1384 AACAGGTATGGGTATTTGGTTTTAGAAGGTATGTGGTTCATCACTATTTATATTATTACTACAAGAACCA
Rps1-k-5_3end 1398 AACAGGTATGGGTA--TGGTTTTAGAAGGTATGTGGTTCATCACTATTTATATTTTTACTACAAGAACCA
Rps1-k-1_3end 1398 AACAGGTATGGGTA--TGGTTTTAGAAGGTATGTGGTTCATCACTATTTATATTTTTACTACAAGAACCA
consensus     1401 **************..**************************************.***************

Rps1-k-2_3end 1454 GGTAAACTTTATTATGGTACAGTAAGTTTGGTGTGAG-TTGTAACTACGTTATATCCATCTCACTTAGCA
Rps1-k-4_3end 1454 GGTAAACTTTATTATGGTACAGTAAGTTTGGTGTGAG-TTGTAACTACGTTATATCCATCTCACTTAGCA
Rps1-k-3_3end 1454 GGTAAACTTTATTATGGTACAGTAAGTTTGGTGTGAG-TTGTAACTACGTTATATCCATCTCACTTAGCA
Rps1-k-5_3end 1466 GGTAAACTTTATTATGGTACAGTAAATTTAGTGTGAGGTTGTAACTACGTTATATCCATCTAACTTAGCA
Rps1-k-1_3end 1466 GGTAAACTTTATTATGGTACAGTAAATTTAGTGTGAGGTTGTAACTACGTTATATCCATCTAACTTAGCA
consensus     1471 *************************.***.******* ***********************.********

Rps1-k-2_3end 1523 CGATAATTAAATTTAAAAGCAAAAAGATAAGAAAAAGGCCAATCTAACAATTGTTACCTCTCTTGCATGA
Rps1-k-4_3end 1523 CGATAATTAAATTTAAAAGCAAAAAGATAAGAAAAAGGCCAATCTAACAATTGTTACCTCTCTTGCATGA
Rps1-k-3_3end 1523 CGATAATTAAATTTAAAAGCAAAAAGATAAGAAAAAGGCCAATCTAACAATTGTTACCTCTCTTGCATGA
Rps1-k-5_3end 1536 CGATAATTAAATTTAAAAGCAAAAAGATAAGAAAAAGGCCAATCTAACAATTGTTACCTCTCTTGCATGA
Rps1-k-1_3end 1536 CGATAATTAAATTTAAAAGCAAAAAGATAAGAAAAAGGCCAATCTAACAATTGTTACCTCTCTTGCATGA
consensus     1541 **********************************************************************

Rps1-k-2_3end 1593 CAAAATCAGAAACAAAAGTCCCACTCTTTCCTCCATGGTGCCTGTAATTAACAAGCACTTCAAAAACCAA
Rps1-k-4_3end 1593 CAAAATCAGAAACAAAAGTCCCACTCTTTCCTCCATGGTGCCTGTAATTAACAAGCACTTCAAAAACCAA
Rps1-k-3_3end 1593 CAAAATCAGAAACAAAAGTCCCACTCTTTCCTCCATGGTGCCTGTAATTAACAAGCACTTCAAAAACCAA
Rps1-k-5_3end 1606 AAAAATCAGAAACAAAAGCCCCACTCTTTCCTCCATGGTGCCTGTAATTAACAAGCACTTCAAAAATCAA
Rps1-k-1_3end 1606 AAAAATCAGAAACAAAAGCCCCACTCTTTCCTCCATGGTGCCTGTAATTAACAAGCACTTCAAAAATCAA
consensus     1611 .*****************.***********************************************.***

Rps1-k-2_3end 1663 TGTTAATTAATTAATTTCCATAAAAAAAAAAAGGCAAAAGCCAATGAAATTTAAGGGGTACAACAAAGAT
Rps1-k-4_3end 1663 TGTTAATTAATTAATTTCCATAAAAAAAAAAAGGCAAAAGCCAATGAAATTTAAGGGGTACAACAAAGAT
Rps1-k-3_3end 1663 TGTTAATTAATTAATTTCCATAAAAAAAAAAAGGCAAAAGCCAATGAAATTTAAGGGGTACAACAAAGAT
Rps1-k-5_3end 1676 TGTTAATTAATTAATTTCCATAAGAAAAAAAAGACAGAAGCTAATGAAATTTAAGGGGTACAACAAAGAT
Rps1-k-1_3end 1676 TGTTAATTAATTAATTTCCATAAGAAAAAAAAGACAGAAGCTAATGAAATTTAAGGGGTACAACAAAGAT
consensus     1681 ***********************.*********.**.****.****************************

Rps1-k-2_3end 1733 TTGTAGAACGATCATTAATATTAGTGCAACGCACCATGATGAAGTGCATGACATAATAATAATGTGGAAC
Rps1-k-4_3end 1733 TTGTAGAACGATCATTAATATTAGTGCAACGCACCATGATGAAGTGCATGACATAATAATAATGTGGAAC
Rps1-k-3_3end 1733 TTGTAGAACGATCATTAATATTAGTGCAACGCACCATGATGAAGTGCATGACATAATAATAATGTGGAAC
Rps1-k-5_3end 1746 TTGTAGAACGATCATTAATATTAGTGCAACACATCATGATGAAGTGCATGACATAATAATAATGTGAAAC
Rps1-k-1_3end 1746 TTGTAGAACGATCATTAATATTAGTGCAACACATCATGATGAAGTGCATGACATAATAATAATGTGAAAC
consensus     1751 ******************************.**.********************************.***

Rps1-k-2_3end 1803 CAATCATGATAAGAACAGAAAATAAATCAATGCAATTGCATGATCAGAAAATAACGAGGCGATATATCAT
Rps1-k-4_3end 1803 CAATCATGATAAGAACAGAAAATAAATCAATGCAATTGCATGATCAGAAAATAACGAGGCGATATATCAT
Rps1-k-3_3end 1803 CAATCATGATAAGAACAGAAAATAAATCAATGCAATTGCATGATCAGAAAATAACGAGGCGATATATCAT
Rps1-k-5_3end 1816 CAATCATGATAAGAACAGAAAATAAATCAGTGCAATTACATGATTAGAAAATAAAGAGGCGATATATCAT
Rps1-k-1_3end 1816 CAATCATGATAAGAACAGAAAATAAATCAGTGCAATTACATGATTAGAAAATAAAGAGGCGATATATCAT
consensus     1821 *****************************.*******.******.*********.***************

Rps1-k-2_3end 1873 GTTCCTATTGAT-AGACAATAGGACAACGTGTTAAAGAAATGTGTCAAGTGCAACAATGAGGGAACGGAG
Rps1-k-4_3end 1873 GTTCCTATTGATCAGACAATAGGACAACGTGTTAAAGAAATGTGTCAAGTGCAACAATGAGGGAACGGAG
Rps1-k-3_3end 1873 GTTCCTATTGATCAGACAATAGGACAACGTGTTAAAGAAATGTGTCAAGTGCAACAATGAGGGAACGGAG
Rps1-k-5_3end 1886 ATTCCTATTGATCAGACAATATGACAACGTGTTAAACAAATGTGTCAGGTGCAATAATGAGGGGATAGAG
Rps1-k-1_3end 1886 ATTCCTATTGATCAGACAATATGACAACGTGTTAAACAAATGTGTCAGGTGCAATAATGAGGGGATAGAG
consensus     1891 *********************.**************.**********.******.********.*..***

Rps1-k-2_3end 1942 AAGAGAAGGATGATAAAGAATGTGGTTATGACTTCTACAAAGTCCAATTATTTACTTTTTTAATTTTTTA
Rps1-k-4_3end 1943 AAGAGAAGGATGATAAAGAATGTGGTTATGACTTCTACAAAGTCCAATTATTTACTTTTTTAATTTTTTA
Rps1-k-3_3end 1943 AAGAGAAGGATGATAAAGAATGTGGTTATGACTTCTACAAAGTCCAATTATTTACTTTTTTAATTTTTTA
Rps1-k-5_3end 1956 AAGAGAAGGATGATAAAGAATGTGGTTATGACTTCTACAAAGTCGAATTATTTACTTTTTTAATTTTTTA
Rps1-k-1_3end 1956 AAGAGAAGGATGATAAAGAATGTGGTTATGACTTCTACAAAGTCGAATTATTTACTTTTTTAATTTTTTA
consensus     1961 ********************************************.*************************

Rps1-k-2_3end 2012 TATTTTCCTTTTCACTTTCCTAATAGTTGTCGGATTAAAAGGAGTTTATGGAGTAGATTAGATTGGTTTT
Rps1-k-4_3end 2013 TATTTTCCTTTTCACTTTCCTAATAGTTGTCGGATTAAAAGGAGTTTATGGAGTAGATTAGATTGGTTTT
Rps1-k-3_3end 2013 TATTTTCCTTTTCACTTTCCTAATAGTTGTCGGATTAAAAGGAGTTTATGGAGTAGATTAGATTGGTTTT
Rps1-k-5_3end 2026 TATTTTCCTTTTCACTTTTCTAATAGTTGGCCGATTAACAGGAGTTTATAGAGTAGATTAAATTGGTTTT
Rps1-k-1_3end 2026 TATTTTCCTTTTCACTTTTCTAATAGTTGGCCGATTAACAGGAGTTTATAGAGTAGATTAAATTGGTTTT
consensus     2031 ******************.**********.*.******.**********.**********.*********
```

-continued

```
Rps1-k-2_3end 2082 GAAAAAGAGAAATATCATCTGATACAATTTTTAGTTTTCTTAATTTATTGTTCAATTGATGTAGTTTAAA
Rps1-k-4_3end 2083 GAAAAAGAGAAATATCATCTGATACAATTTTTAGTTTTCTTAATTTATTGTTCAATTGATGTAGTTTAAA
Rps1-k-3_3end 2083 GAAAAAGAGAAATATCATCTGATACAATTTTTAGTTTTCTTAATTTATTGTTCAATTGATGTAG------
Rps1-k-5_3end 2096 GAAAAAGAGAAATATCATCTTATACAATTTTTGGTTTTCTTAATTCATTGTTCAATTGATGTAGTTTAAA
Rps1-k-1_3end 2096 GAAAAAGAGAAATATCATCTTATACAATTTTTGGTTTTCTTAATTCATTGTTCAATTGATGTAGTTTAAA
consensus     2101 ********************.***********.***********.******************......

Rps1-k-2_3end 2152 AAGTTGCACTAACTGAAGTGGAAAAGGAACATAGGTTGGCATAATGGAAT  (SEQ ID NO:162)
Rps1-k-4_3end 2153 AAGTTGCACTAACTGAAGTGGAAAAGGAACATAGGTTGGCAT--------  (SEQ ID NO:166)
Rps1-k-3_3end      --------------------------------------------------  (SEQ ID NO:164)
Rps1-k-5_3end 2166 ATTTAAATATGATTTAA--TAAGTTTGGATTGATCTCGA-----------  (SEQ ID NO:168)
Rps1-k-1_3end 2166 ATTTAAATATGATTTAA--TAAGTTTGGATTGATCTCGA-----------  (SEQ ID NO:160)
consensus     2171 .  .   ... . ..   ...  ...  .  . ..

Alignment of the predicted amino acid seqeneces showing the variable residues

Rps1-k-5     1 MAAALVGGAFLSAFLDVLFDRLASPDFVDLILGKKLSKKLLRKLETTLRVVGAVLDDAEKKQITNTNVKH
Rps1-k-1     1 MAAALVGGAFLSAFLDVLFDRLASPDFVDLILGKKLSKKLLRKLETTLRVVGAVLDDAEKKQITNTNVKH
Rps1-k-3     1 MAAALVGGAFLSAFLDVLFDRLASPDFVDLILGKKLSKKLLRKLETTLRVVGAVLDDAEKKQITNTNVKH
Rps1-k-2     1 MAAALVGGAFLSAFLDVVFDRLASPEFVDLIRGKKLSKKLLQKLETTLRVVGAVLDDAEKKQITNTNVKH
Rps1-k-4     1 MAAALVGGAFLSAFLDVVFDRLASPEFVDLIRGKKLSKKLLQKLETTLRVVGAVLDDAEKKQITNTNVKH
consensus    1 *****************.*******.*****.*********.****************************

Rps1-k-5    71 WLNALKDAVYEADDLLDHVFTKAATQNKVRNLFSRFSDRKIVSKLEDIVVTLESHLKLKESLDLKESAVE
Rps1-k-1    71 WLNALKDAVYEADDLLDHVFTKAATQNKVRNLFSRFSDRKIVSKLEDIVVTLESHLKLKESLDLKESAVE
Rps1-k-3    71 WLNALKDAVYEADDLLDHVFTKAATQNKVRNLFSRFSDRKIVSKLEDIVVTLESHLKLKESLDLKESAVE
Rps1-k-2    71 WLNDLKHAVYEADDLLDHVFTKAATQNKVRDLFSRFSDRKIVSKLEDIVVTLESHLKLKESLDLKESAVE
Rps1-k-4    71 WLNDLKHAVYEADDLLDHVFTKAATQNKVRDLFSRFSDRKIVSKLEDIVVTLESHLKLKESLDLKESAVE
consensus   71 ***.**.***********************.***************************************

Rps1-k-5   141 NLSWKAPSTSLEDGSHIYGREKDREAIIKLLSEDNSDGSEVSVVPIVGMGGVGKTTLAQLVYNDENLKEK
Rps1-k-1   141 NLSWKAPSTSLEDGSHIYGREKDREAIIKLLSEDNSDGSEVSVVPIVGMGGVGKTTLAQLVYNDENLKEK
Rps1-k-3   141 NLSWKAPSTSLEDGSHIYGREKDREAIIKLLSEDNSDGSEVSVVPIVGMGGVGKTTLAQLVYNDENLKEK
Rps1-k-2   141 NLSWKAPSTSLEDGSHIYGREKDKEAIIKLLSEDNSDGREVSVVPIVGMGGVGKTTLAQLVYNDENLKQI
Rps1-k-4   141 NLSWKAPSTSLEDGSHIYGREKDKEAIIKLLSEDNSDGREVSVVPIVGMGGVGKTTLAQLVYNDENLKQI
consensus  141 ***********************.**************.*****************************..

Rps1-k-5   211 FDFDFKAWVCVSQEFDVLKVTKTIIQAVTGNPCKLNDLNLLHLELMDKLKDKKFLIVLDDVWTEDYVDWS
Rps1-k-1   211 FDFDFKAWVCVSQEFDVLKVTKTIIQAVTGNPCKLNDLNLLHLELMDKLKDKKFLIVLDDVWTEDYVDWS
Rps1-k-3   211 FDFDFKAWVCVSQEFDVLKVTKTIIQAVTGNPCKLNDLNLLHLELMDKLKDKKFLIVLDDVWTEDYVDWS
Rps1-k-2   211 FDFDFKAWVCVSQEFDVLKVTKTIIEAVTGKACKLNDLNLLHLELMDKLKDKKFLIVLDDVWTEDYVDWR
Rps1-k-4   211 FDFDFKAWVCVSQEFDVLKVTKTIIEAVTGKACKLNDLNLLHLELMDKLKDKKFLIVLDDVWTEDYVDWR
consensus  211 *************************.****..*************************************

Rps1-k-5   281 LLKKPFQCGIIRRSKILLTTRSEKTASVVQTVQTYHLNQLSNEDCWSVFANHACLSLESNE-NTTLEKIG
Rps1-k-1   281 LLKKPFQCGIIRRSKILLTTRSEKTASVVQTVQTYHLNQLSNEDCWSVFANHACLSLESNE-NTTLEKIG
Rps1-k-3   281 LLKKPFQCGIIRRSKILLTTRSEKTASVVQTVQTYHLNQLSNEDCWSVFANHACLSLESNE-NTTLEKIG
Rps1-k-2   281 LLKKPFNRGIIRRSKILLTTRSEKTASVVQTVHTYHLNQLSNEDCWSVFANHACLSTESNENTATLEKIG
Rps1-k-4   281 LLKKPFNRGIIRRSKILLTTRSEKTASVVQTVHTYHLNQLSNEDCWSVFANHACLSTESNENTATLEKIG
consensus  281 ******..************************.***********************.****...******

Rps1-k-5   350 KEIVKKCDGLPLAAQSLGGMLRRKHDIGDWYNILNSDIWELSESECKVIPALRLSYHYLPPHLKRCFVYC
Rps1-k-5   350 KEIVKKCDGLPLAAQSLGGMLRRKHDIGDWYNILNSDIWELSESECKVIPALRLSYHYLPPHLKRCFVYC
Rps1-k-5   350 KEIVKKCDGLPLAAQSLGGMLRRKHDIGDWYNILNSDIWELSESECKVIPALRLSYHYLPPHLKRCFVYC
Rps1-k-5   351 KEIVKKCNGLPLAAESLGGMLRRKHDIGDWNNILNSDIWELSESECKVIPALRLSYHYLPPHLKRCFVYC
Rps1-k-5   351 KEIVKKCNGLPLAAESLGGMLRRKHDIGDWNNILNSDIWELSESECKVIPALRLSYHYLPPHLKRCFVYC
consensus  351 *******.******.***************.***************************************

Rps1-k-5   420 SLYPQDYEFDKNELILLWMAEDLLKKPRKGRTLEEVGHEYFDDLVSRSFFQRSSTNRSSWPYGECFVMHD
Rps1-k-1   420 SLYPQDYEFDKNELILLWMAEDLLKKPRKGRTLEEVGHEYFDDLVSRSFFQRSSTNRSSWPYGECFVMHD
Rps1-k-3   421 SLYPQDYEFDKNELILLWMAEDLLKKPRKGRTLEEVGHEYFDDLVSRSFFQRSSTNRSSWPYGECFVMHD
Rps1-k-2   421 SLYPQDYEFEKNELILLWMAEDLLKKPRKGRTLEEVGHEYFDDLVSRSFFQRS--RTSSWPHRKCFVMHD
Rps1-k-4   421 SLYPQDYEFEKNELILLWMAEDLLKKPRKGRTLEEVGHEYFDDLVSRSFFQRS--RTSSWPHRKCFVMHD
consensus  421 *********.*******************************************....****...******

Rps1-k-5   490 LMHDLAKSLGGDFYFRSEELGKETKINTKTRHLSFTKFNSSVLDNFDVVGRAKFLRTFLSIINFEAAPFN
Rps1-k-1   490 LMHDLAKSLGGDFYFRSEELGKETKINTKTRHLSFTKFNSSVLDNFDVVGRAKFLRTFLSIINFEAAPFN
Rps1-k-3   490 LMHDLAKSLGGDFYFRSEELGKETKINTKTRHLSFTKFNSSVLDNFDVVGRAKFLRTFLSIINFEAAPFN
Rps1-k-2   489 LMHDLATSLGGDFYFRSEELGKETKINTKTRHLSFAKFNSSVLDNFDVIGRAKFLRTFLSIINFEAAPFN
Rps1-k-4   489 LMHDLATSLGGDFYFRSEELGKETKINTKTRHLSFAKFNSSVLDNFDVIGRAKFLRTFLSIINFEAAPFN
consensus  491 ******.****************************.************.*********************

Rps1-k-5   560 NEEAQCIIVSKLMYLRVLSFCDFQSLDSLPDSIGKLIHLRYLDLSHSSVETLPKSLCNLYNLQTLKLCSC
Rps1-k-1   560 NEEAQCIIVSKLMYLRVLSFCDFQSLDSLPDSIGKLIHLRYLDLSHSSVETLPKSLCNLYNLQTLKLCSC
Rps1-k-3   560 NEEAQCIIVSKLMYLRVLSFCDFQSLDSLPDSIGKLIHLRYLDLSHSSVETLPKSLCNLYNLQTLKLCSC
Rps1-k-2   559 NEEAQCIIMSKLMYLRVLSFCDFQSLDSLPDSIGKLIHLRYLDLSFSRIETLPKSLCNLYNLQTLKLCSC
Rps1-k-4   559 NEEAQCIIMSKLMYLRVLSFCDFQSLDSLPDSIGKLIHLRYLDLSFSRIETLPKSLCNLYNLQTLKLCSC
consensus  561 ********.************************************.*..*********************

Rps1-k-5   630 RKLTKLPSDMCNLVNLRHLEIRETPIEEMPRGMSKLNHLQHLDFFVVGKHKENGIKELGGLSNLRGRLKI
Rps1-k-1   630 RKLTKLPSDMCNLVNLRHLEIRETPIEEMPRGMSKLNHLQHLDFFVVGKHKENGIKELGGLSNLRGRLKI
Rps1-k-3   630 RKLTKLPSDMCNLVNLRHLEIRETPIEEMPRGMSKLNHLQHLDFFVVGKHKENGIKELGGLSNLRGRLKI
Rps1-k-2   629 RKLTKLPSDMRNLVNLRHLGIAYTPIKEMPRGMGKLNHLQHLDFFVVGKHEENGIKELGGLSNLRGQLEI
Rps1-k-4   629 RKLTKLPSDMRNLVNLRHLGIAYTPIKEMPRGMGKLNHLQHLDFFVVGKHEENGIKELGGLSNLRGQLEI
consensus  631 **********.********.*..***.******.****************.***************.*.*

Rps1-k-5   700 RNLENVSQSDEASEARMMDKKHINSLWLEWSRCNNNSTNFQLEIDVLCKLQPHFNIESLRIKGYKGTRFP
Rps1-k-1   700 RNLENVSQSDEASEARMMDKKHINSLWLEWSRCNNNSTNFQLEIDVLCKLQPHFNIESLRIKGYKGTRFP
Rps1-k-3   700 RNLENVSQSDEASEARMMDKKHINSLWLEWSRCNNNSTNFQLEIDVLCKLQPHFNIESLRIKGYKGTRFP
Rps1-k-2   699 RKLENVSQSDEALEARMMDKKHINSLQLEWSGCNNNSTNFQLEIDVLCKLQPHFNIESLEIKGYEGTRFP
Rps1-k-4   699 RKLENVSQSDEALEARMMDKKHINSLQLEWSGCNNNSTNFQLEIDVLCKLQPHFNIESLEIKGYEGTRFP
consensus  701 *.**********.*************.****.***************************.****.*****
```

-continued

```
Rps1-k-5   770 DWMGNSSYCNMMSLKLRDCDNCSMLPSLGQLPSLKVLKIARLNRLKTIDAGFYKNEDCRSGTPFPSLESL
Rps1-k-1   770 DWMGNSSYCNMMSLKLRDCDNCSMLPSLGQLPSLKVLKIARLNRLKTIDAGFYKNEDCRSGTPFPSLESL
Rps1-k-3   770 DWMGNSSYCNMMSLKLRDCDNCSMLPSLGQLPSLKVLKIARLNRLKTIDAGFYKNEDCRSGTPFPSLESL
Rps1-k-2   769 DWMGNSSYCNMISLKLRDCHNCSMLPSLGQLPSLKDLGIARLNRLKTIDAGFYKNEECRSGTSFPSLESL
Rps1-k-4   769 DWMGNSSYCNMISLKLRDCHNCSMLPSLGQLPSLKDLGIARLNRLKTIDAGFYKNEECRSGTSFPSLESL
consensus  771 ***********.*******.***************.*.******************.*****.*******

Rps1-k-5   840 AIHQMPCWEVWSSFDSEAFPVLEILEIRDCPKLEGSLPNHLPALKTLTIRNCELLGSSLPTAPAIQSLEI
Rps1-k-1   840 AIHQMPCWEVWSSFDSEAFPVLEILEIRDCPKLEGSLPNHLPALKTLTIRNCELLGSSLPTAPAIQSLEI
Rps1-k-3   840 AIHQMPCWEVWSSFDSEAFPVLEILEIRDCPKLEGSLPNHLPALKTLTIRNCELLGSSLPTAPAIQSLEI
Rps1-k-2   839 SIDDMPCWEVWSSFDSEAFPVLNSLEIRDCPKLEGSLPNHLPALTKLVIRNCELLVSSLPTAPAIQSLEI
Rps1-k-4   839 SIDDMPCWEVWSSFDSEAFPVLNSLEIRDCPKLEGSLPNHLPALTKLVIRNCELLVSSLPTAPAIQSLEI
consensus  841 .*..*****************..********************..*.*******.**************

Rps1-k-5   910 RKSNKVALHAFPLLVETIKVEGSPMVESMMEAITNIQPTCLRSLTLRDCSSAVSFPGGRLPESLKSLYIS
Rps1-k-1   910 RKSNKVALHAFPLLVETIKVEGSPMVESMMEAITNIQPTCLRSLTLRDCSSAVSFPGGRLPESLKSLYIS
Rps1-k-3   910 RKSNKVALHAFPLLVETIKVEGSPMVESMMEAITNIQPTCLRSLTLRDCSSAVSFPGGRLPESLKSLYIS
Rps1-k-2   909 CKSNKVALHAFPLLVETIEVEGSPMVESVIEAITNIQPTCLRSLTLRDCSSAVSFPGGRLPESLKSLSIK
Rps1-k-4   909 CKSNKVALHAFPLLVETIEVEGSPMVESVIEAITNIQPTCLRSLTLRDCSSAVSFPGGRLPESLKSLSIK
consensus  911 .*****************.*********..***************************************.*.

Rps1-k-5   980 DLKKLEFPTQHKHELLETLSIESSCDSLTSLPLVTFPNLRDLEIRNCENMESLLVS--------------
Rps1-k-1   980 DLKKLEFPTQHKHELLETLSIESSCDSLTSLPLVTFPNLRDLEIRNCENMESLLVS--------------
Rps1-k-3   980 DLKKLEFPTQHKHELLETLSIESSCDSLTSLPLVTFPNLRDLEIRNCENMESLLVS--------------
Rps1-k-2   979 DLKKLEFPTQHKHELLETLSIESSCDSLTSLPLVTFPNLRYLSIEKCENMEYLLVSGAESFKSLCYLLIY
Rps1-k-4   979 DLKKLEFPTQHKHELLETLSIESSCDSLTSLPLVTFPNLRYLSIEKCENMEYLLVSGAESFKSLCYLLIY
consensus  981 ****************************************.*.*..*****.****

Rps1-k-5  1036 -------FWREGLPAPNLITFQVWGSDKLKSLPDEMSTLLPKLERLLISNCPEIESFPKRGMPPNLRIVW
Rps1-k-1  1036 -------FWREGLPAPNLITFQVWGSDKLKSLPDEMSTLLPKLERLLISNCPEIESFPKRGMPPNLRIVW
Rps1-k-3  1036 -------FWREGLPAPNLITFQVWGSDKLKSLPDEMSTLLPKLERLLISNCPEIESFPKRGMPPNLRIVW
Rps1-k-2  1049 KCPNFVSFWREGLPAPNLITFSVWGSDKLKSLPDEMSTLLPKLEDLTISNCPEIESFPKRGMPPNLRRVE
Rps1-k-4  1049 KCPNFVSFWREGLPAPNLITFSVWGSDKLKSLPDEMSTLLPKLEDLTISNCPEIESFPKRGMPPNLRRVE
consensus 1051        **************.**********************.*.********************.*.

Rps1-k-5  1099  IFNCEKLLSSLAWPSMGMLTHLYVGGRCDGIKSFPKEGLLPPSLTYLYLSGFSNLEMLDCTGLLHLTSLQ
Rps1-k-1  1099  IFNCEKLLSSLAWPSMGMLTHLYVGGRCDGIKSFPKEGLLPPSLTYLYLSGFSNLEMLDCTGLLHLTSLQ
Rps1-k-3  1099  IFNCEKLLSSLAWPSMGMLTHLYVGGRCDGIKSFPKEGLLPPSLTYLYLSGFSNLEMLDCTGLLHLTSLQ
Rps1-k-2  1119  IVNCEKLLSGLAWPSMGMLTHLNVGGPCDGIKSFPKEGLLPPSLTSLSLYDLSNLEMLDCTGLLHLTSLQ
Rps1-k-4  1119  IVNCEKLLSGLAWPSMGMLTHLNVGGPCDGIKSFPKEGLLPPSLTSLSLYDLSNLEMLDCTGLLHLTSLQ
consensus 1121  *.*******.************.***.*****************.*.*...******************

Rps1-k-5  1169 QLTIDGCPLLENMVGERLPDSLIKLTIKSCPLLKKRCRKKHPQIWPKISHIPGIKVDNRWI (SEQ ID NO:169)
Rps1-k-1  1169 QLTIDGCPLLENMVGERLPDSLIKLTIKSCPLLKKRCRKKHPQIWPKISHIPGIKVDNRWI (SEQ ID NO:170)
Rps1-k-3  1169 QLTIDGCPLLENMVGERLPDSLIKLTIKSCPLLKKRCRKKHPQIWPKISHIPGIKVDNRWI (SEQ ID NO:171)
Rps1-k-2  1189 QLQIFGCPLLENMAGESLPFSLIKLTMVECPLLEKRCRMKHPQIWPKVSHIPGIKVGNRWI (SEQ ID NO:172)
Rps1-k-4  1189 QLQIFGCPLLENMAGESLPFSLIKLTMVECPLLEKRCRMKHPQIWPKVSHIPGIKVGNRWI (SEQ ID NO:173)
consensus 1191 **.*.***.****.**.**.******...****.****.********.********.****
```

Sequence of the PrsI-k region (sequences are from three BAC clones BAC18, 43 and 90 shown in FIG. 1 of the example 1)

```
>BAC18.FASTA.SCREEN.CONTIG1 (SEQ ID NO: 174)
ATTTAGGTGACACTATAGAATACTCAAGCTTGCATAATTCATCAAGGTATCAATATCCACTCCCAAGGCACCACAAA

AGCCTTGATGGAAATTCATTTTGAGGCCCGAGACAAGTTCAAAGCCTCTCAAAATGCTTTTTATGGTAAGCACCTTA

GAAATGGTTGCTTCTCCTGTAAAGAGTGCGTCAAGCGTCATTTGCATATTGAAGCAAGTTTACTTCCTCTCTCCCACT

ACCCACTAAGAAATTAGAGAATTGTTCCTTCAAGTGCTTGCCTCGTGTTTTTATGAGACAATTCATCATCATAATA

TAATCTCAAAATAATATCTATTCCTTATCAAAAAAGGATACTACCAAGATACTTACAAAATTAACATTTAAATGTTG

AAAATTGTCTCATATAAGATAATATATATTAATAATGATTGCCAACAAATAAGTAGCATGAAGTACATTAAGAAGAA

AAAAATCCCTTCTTATTCAATTTTTTTTCTCGTTCTAGCGACTAAATATTTTATATCAAAGCGTCTTGAATTAGAC

AACATTGTTTTCAAAGAAAATGAAGTTTGGGAGAATATGTTGAGTTTAATTAGTGGAGGTACTTCACAAAAATTTTA

GAAGGAAGGTAATTGTTAGACATTTTTGTTAATGGGAGCGAGGAAATCTTTGGAGGTGATGATCCCCTCTCAATTT

CCGAATAAATAACCGAAGAACAATTAAAACTATAGAAAAATATCAAGATTCCTTAAGGAAGAATCCATAAATATTA

AATGATCACTGAAATAAATCAAATAAAAAAAAGTTGAAGGACGAAAGTGAAACCAAGCCTTACATTAAAAGATAAA

AATATTACTTTTACCTTCATGAATTTTATATAAATCTTATTTAGTAAATAAAGTTTAATATTTTGTAAAAAAAAAATC

ATATAAAATGGATTCAACAATAATGTAAAAACAAAAAAATATTAGATATTCTTTAAATAATAAGGTACTTCGGTTTG

TAGAACACATTCTCAAGTTTAAAGAGCTTCAACCCGACCTTTGAAACAATTAACCTAGGGTTAGCTCGATTTGGTTT
```

-continued

AAGCCAGACTTGATTTAACTAAGAAATTCAAACCGAACTAATTGGTTTGGTTCCGATAAGCAAAACAATATAGCTTT

AAATAGGGTTTGTCTAACTAAACCTAAGTAAAAATTTCACTGAAAAATTCAAACTTGCTTCTTATGATTTTTAATGAA

ATTCAAATAACATTCTAGAAAATATGTAGCGTAAACATGGCAGGAGATAGGTAAGTACAGGAATATGTTGGGTCGTT

CACAGCAGGAACTTGAGCCACTGATACAACTATTGAGGAAGAGCAAAGAGGTTGTTTACAAGTGTTCAAAAATAGG

GAAATACAATTTTGTGGCTAAGAATTCTTACCGTGGAAAACTAAAATTAAAGATCTTGCAGACTCAATTGAGAGGTT

TTTCAATATTGAAATGCCAGCTCTTATTGCACGCGATCAACTTGAGATCTTGCTTAGGGTTAGTGAAATAGAATACTT

CAATGATGAAAAGTTTTCCGATTCGGTGATCGCGCCATTAGCTATAGCTGCTGCTGTTACTGTTGCTATAGTTATTAA

ATGTCTTCTGTTCTAATTTTTTCATGATTAATTAGGGATATTGGATAGTCTGGATAAGGTTTTAGTTTCAAACTTTAT

TGTCTTTATTGTATATAAGCAACCGATTTGTCACGCCTATTATGTTTTTGCTTTTTTATTGTACTTTCGCATTTCTATTA

AGCTAATTAAAGATGTTATATATATAGTTAAAAAATTCTTTCATATGTTTTTAAATGCATGTTTATCTTTAGAATTTTC

TTACTTCTTATACTCTACTATTTATGATAATATATAGTAATTCAATTTTATTTTGTATATTGCATGTAGGCTACCGTA

TTTTTTTTCCAACAAAATGATTTGTATTAAATGGTACCAAAATTACCTAAGATCCAAAAACATATACACCAGTGACA

GTAGAAAGAAAGATAGCTAGCTTCGAACATGGACCATTACACCCAAAGTCATGGTTTTAAAATGTAGTCAGCAACC

ATAATTGCAGTCATAACGCTAATGTATTTTGACTCTGTAATCACATCACAATTATAATTATGATCACATCAGTTTGTA

TTTTTCCATAATTATCCACAATGTAAGATTTTTAGGTTCGTTGCATGCAACGCAATCATAATTGCAATTTAAAATCAT

GTCTAAAGCCATGCAACATTGATGCGGCATCACTAACCAGCCCCCACCATCGTGCACATAAACATCGGTTGCATTTG

GGATGATCCCACTCGAAGAGCAGCTACCACCGAATCAAATTAACTTCACATTTCATTCAAAATTGTCTCTTCATGAA

ACAAGCTCCAGGTGCCATATATCATTAAGTAAAACAATAATTAAAATTAGGGACTCTGGCTTTTATTAATCCACGAT

CGTGCAAAGAATAATATATTCTGCGTAATTTTCTCAGCATTGAAAGAGCCATTAATTCCTTAGCATACACTCATTCCT

AGCATTCCATACACACCAAAATTTCTGATGCCCACACCGCCCTCCATACATCTGCCTCCTTCTTTGAACTTACGAAT

ACAGAATCTTGCCAAAAATGTGATTCTGGTCATTGTGGCAACACCACATTTACATGCAGCCAGCAGCCAAGAGTAAC

ATTGCCTCCAAATTAGTACCAAGAATTTTATGACATGAGAAGAAACAGTGAGATACCGACTCATCTACCTCAAGGCA

AAAGGGACATAAGCACTCATGAGGATTATAAATGGTGTTTCTCCTTTTTAGATTATCCTTCGTTGGTAGTCAATCAAT

CAAGCATCACTCTCCAAATTAAGAAACACGCCTTAGGTTGTATATACCTTAGTGTAGTAGTATGAGAAAAAATATCC

AAGTTAAATAGAAAATTATTTTTATAAATATGAACACTTTTTTTAAGGCAAAATGTAAAAAGAAAAGTTGCAATTTCT

CCCCAATCTCTGCAAGAGGTACATGTGTTACCGTATTACATACATAAAAAAATGGTTTCTCCTAAGTTAACTTTCAGT

CCTAAAAAATGCCACTGTTAACTTCTCTAACATCAATCACATTTGAAGTGGCTCCAAACACCAGCAAGAGAAGAAA

GTTCATGGTTTTTTGCCTTATATAACAACCACTGCCATGAGATATGTTTTACGGCTGTCAAAATACCCCCTGGTTCAC

ACTTTTTGCAACTAAAGGCTATCATATAAAATATTTCTGTTGGCCGAAATCGGTTACGTTTCTTTTGATCGACCTTGG

TCGAAGTTATTTTTTGATCAATGTCGGTTAGAAATTTTTTTGTTAACCTTAGTCAATGATGTTTGTGATCGATATCAAC

CGATTATATTTTTTTACCAACATCTTGTCAGGACTATTTTTTGGTCAACGTCACCTTGGTTTTTTCGGTCAATGCGACA

AAGCTTGTTACCAGGAACAACTTGAGGCACTTGCGGACTCGCTTGTCAGGTTTTTCATCATTGACATGCAAGCTCAG

ATGGCAAGAGACCAGAAGGAGATCCTGCTTTAAGGTAGGAGAATACTTAGCGCTGTTAATAAATTTCCCTCCCACAC

AGTTGATGCATCTAACCCTGAAGAAAATGCAATTCTAGTATGGAAGCAACAAATACAAGTTTGTCTTTGTCCTGCTA

TTCTGATCCTCTCTCTATCCAGATGTATATATGTTTGTTAGTGCATATATATATATATGCATCCATGTATATATGTTTG

CATATACATACATATATGAATGTACGTAGATATATTCATATATATATATATATATATATATATATATATATATATATA

TATATATATACGTGCTTTGTGCATGTAACCATTTGCATTTAAAGAGTTTGTATCATTATCTTTGAAACATCTTTTTACG

CTATTTTCAATCAATACAAGAATTTTAGATCATTATCTTATTCGTTACTTCTCTTTAATTATATTTGTTAAGTTAAAAA

ATATTAATGCTTTAAGATGAATTAAGACTCCTAATTGTAACCACATCAGCCATACTTTCCCGTGATAATTCATTTCTG

GTTTGGCAACATTTCCCACCTCAACTATCTGTGTCTCTTTTAGTAAATTCAGTAGGGATTGTAAGATTATGTGCTTAG

-continued

TTTGCTTTGTTTTTTTAGTTTTATGATGTATAAAAAATTATAGATCAGTTAGTAGTTTGGTTTTAGGTTTTGTTCTGGTC

TAGATCGGATCATGTTCCGATCTTCTACATCTTTAGCTTTTACGCACTGTGTGCTTGAAGCTAAGGGGTTATCTTTTG

GTTCAGATTGGAATGTATTGGATTATGTTCCGATCTTCTATCACGCATCAAGCCCATAAAAGAGGCTTAGGTCAATTC

ACTTTCAAAGTTGGGCCTTGCCAAGCGGGATCAAACGACCACCTTAAGGGGGATTGACGATAATCCGACTATTTCGG

CAGAATAAGGGATTAACTGATTGTTTATGATATGCTGGTGATGCATCATGAAGGGACAACTAACATAAACTTAATAG

CACGAAACATTTGCGGGATATGATGGAATATTTTGATGCAGCATAAAGACCCCAACTTGTAAAAATTGTGGGGGGAC

TGAATGTGCTTCATTTTGAGGAGGCTTTTTCCGGAACAGGTTTTGTTATATTTTTATTGCATGTTATTTAGAATTAAAAT

CTATTATGTCAGTTGTGCATATAGCTTGCGTCAAGTGAATCAATAAAGATTGAACTCGTTTCATATTATATTGATTTG

ATAGTTATATTTCTTAAGTGGGAAAATATTGAGATTCTTAGAACATTTTTGTCAAAGAATCCATTTTAGGTTCTTGGA

TTATTTTTTGTGAGTCCCATGATGTTATATAGGATGCAAGAACTTCTATCATTTGTTATTCTAATAGTAGAATCCAATT

TGGATTATTAGATTTTACTAGCACAAGAAAAAAATAATATTTTTGAAAAAATAGTAGTTCTTTTCCTAGAACCCAATCT

CCATCTTAAAAAACTCTTAATAAGAATAATAGTAGATCTAGTGGATAGGGTTCTTGAGTTCAAGAATCCCATTAAAG

ATGCTATTGGGCCTTTGACAAACTGTCCATGTTGTGCTACTCATTAACAAACCTGTGCTTACATTTCATAGGCTCTGG

TGAAAAAATAGATAAAAGTTATTTATATACAAATATTTCTAAACATTATTAAATGTATTACATAAAAACTATAGACC

AATAATATCATTAAAAATGACGCATTTTAATATGTTAAGCAAATAAGATAATTTCAATCAATCTCGAACAGAAAATA

TATAGAGAGAGATATCGAGTTTAATACTTATGTATTGATGATGTAAAATGATTTTACACTATTATAAATTATTGTTTG

AATTACTTTAAAATAATTATTTTAAAAGTCAACAAACTTATCACATAGTGAGTTGCAATTAGGTAATGGTTTAAATAT

ATTTTTGGTCTCTGATAAATACTCATTTTTTGCATTTGGTCCCTAATAAATTTTTGCTTTGTGATAGGTCCCTAATATT

TAAAAAGCTTTGTTCGAAGTTCCTGCCGTTAGTCGAAATCCATTATCTTCATATGTGATCGATAACCGATCACGTAAG

ATTTTTTATTTTTTTATAGAAAAAAGTAAAAAAACGACATCATTAAGTCCCCGAATCCTCCAAACCACCCCCACCAG

TCCCCAACCAACTCCTCCACTAGCTCCACACCACCGCTATTGTGTCTCCAAAACCCCCCAAACGTCCCTTGAAACCC

CATGGCAGCAACACAACAATAATTCTAACCCATTTTCTTTTTTTCTTCTCTTGAACCATGGCTCCCCATGGCAACAAC

AAATCTCCTTCTCTAAAAAATCACTCATGGACCCCCCTTCCCCAAAGAAAACCCTCCTCTTTGTTTTCATCATTTCCT

TCTCTTCACCTACGACACACAAGTGAGTTTGAGGGCCAAGTGTGAGAGAGAGACTGGGAGAGAAGTGAGGTTTGAG

AGTTGAAGGAAGTTACTGGTGGTAGCTGGCGCTGGCACGAGCAGTGGCACGACTGGCAACACCAGTGGTGGCCGAT

GGCTGGGTTGGTGGTGACCTTTAAGAAGGGAGAACAAGAAGAGACAACCATGAAAGCAAGGGTTTGCAAAAAGAG

CTCGCAACTATGAAAGGTCGACGACAAGTTCAGACATCGCTATCCCACTCATTTTTTCGTGCTCTATGCAATGGACC

GAGCGGAATCGCATTTTAGGGTAAGGTTTTGTTGACCTTCTTCTACCCATGAAACTATTTTGATGTGTTCTCTTAGAA

ACCTTATCCATGTGAATTTCTTGAGTTGGGAGTTGGCTTGGTTTGATTTGAAAATGTAAAATTGATTGCAAGATCCTA

AAAATCGTTGGTGAGGACCTCTTCACCTTGGATCTTCACGAGTGACGAAGTCATAGTGACAAATCCATAAGAAAGGT

ATAGAAGAAACTATAATGGGTTGTGTGAAAACGTAGAGGAATGCTGAAGAATGATTTTTTGATGCCCAAGGGATTTT

GACTATAGTTTCTTATCATTAGTCAAAATCCGTTATTTGCTGAAGAATGATTCTTTTATGCCCAAGGGATTTTGACTA

TAGTTTCTTATCATTAATCCTAATCTCAGTCAGACAAAAATCACACATGACATGTCTGTGTGGCTGGTTAACGATCGT

GTGAGCAAATAACAGATTTTGACTAATGATAAGTATTTCAAACAAAACTTTTTAAATATTAGGAACCTATTACAAAG

CAAAAATTTATTAAAGATCAAATGCTATCCATTCCATTATGCCAACCTATGTTCCTTTTCCACTTCAGCTAGTGCAAC

TTGTACGGCTGATTCTTTCTGCTGTCATACACAAGCATGTCTTGTTTCTGAGGCCCATTTGTCCTTTCTTTTTCTATTC

CCCACCCCCTCTTTTCCCTATCCTTTTATATACCTTCATTATGGACCTATCAAGTTCTAACCAGGAAAATTCCAAAAA

CATTTCTAACCCAAATCTCCAAATTTACATGATGTCAAATAAGAAACAAACTAATAAATAAGAAAATGTGATTAAAA

ATAATATATAACACTACAGAGAAAAAAATCAGAAAATTAATTTTCCATGCATACTATAAAGAGATTACAAAGTAAA

AAAATATATATTTTCATGGAAGAAATGTTCATGTGAACACAATAATTACCTTGACTCCGTATAGTGATATTTTGTTGC

-continued

ATATCATTGCAGCAACTTTTTCAAGAGAATGACTTGAGTATTTCCCACCTCTAGCTTCTTCTTCAATTTTATTTGCAGA

ACTGTTGGAATTTGAATCAGTGGGAACTTGCAGCAAGCAAGCAACAGAAGCAAGGGGGTGCAATTAGAAAACAAGA

CCAAGAGAGCAATTACAAGACCCACTTACCTCAAGGATTAGGTGTGAAACAAGCAGGTGCATCATATCTGGAAGAA

TGATGCTGGTCGGGTAGGAATAGACAAACTTAACAATTTCCTGATATTCTGTAGCACAAAAAGACAAATTTCGATTAT

TGAGAAATCAGTATAAATAATACTATGTAATAACAACATCAATCAATGGAATATACAATTGTTCCTTCCCTTATTCTT

CTCATCTTCTCTCCGTGGAGGCCCTGGTCCTTGAAAACCAGCTTCTATCTTCTTCCCTATCAACAAGTATATAGCAT

ATATAATTATGTATGATAATTTTAAGAAAATAAACAACACTAATATAAAATATATAGAATAGTAAAATACAAAAAAA

AAAAACAAGATCATATCTGCATTTCCAGAAGTATTTTATGGAATCTAGATTACCCAGGAAGTTAAATTAAAAACTTG

AAAGAAGAAACAGAGAAAAAAGAAAATATTTTAAGATAAGTTGTAACCCGGAATCAAAATAAAAGTTTATAAATAA

TTCAAGCACATATATATATATTTGGTGTCTTGATCTTATTGATGTATTTTGCAGACATTGATATACTTTTATTACCCTAT

AGAGCTAGAACAAGATCAACTAATTGAAGGTTTAGTGACATTGTCACAAAGCAAAGAAAATGCCTGATTTATGAAT

ATTCACTTTGAATCTACGTGAGTCAGAACAATTTCGTTCACCAAAATATGCCATTGCAGTTGAGGTGGTCGGTCGTAT

GTGAAAGAGTCTGTTATGAGATGATGATCTTTTCATGCATTTCGGTATTGTCCTTTGCATTAACACTTACACAACATT

CTCCAACTGAGTTAGCAGTTTGTCAGTAGTGAAACCCTCCTTGTCCAACAATTCCATATGAGGAACACTACCTGACA

ACATTGCTGATTTCAAAAGCCTTGAATTCTTGGATATCTCTTATAAACTCTTTTCCTCATCCTTGCCATTGGGAATTGG

TAAATTAGGGAGCTTGCAGAATCTCTCGTTGGCTGAAAATAACTTCTCCTGACTCTATTTCAGAGATGGCCTCCATCA

AGTCCCTCAACTTGACTTGCATGGGAATATGCTTCAAGGTGTACCCAACAGTAGTATGTTAGAAATTCTGAGGAACT

CTATGCATTCTGCACTCTACTTTTTCACGAAATGCCTCCATTTCAAACCAAATAAAATGGTGATCAAATCTTCAATTC

TCTCATTAAACCAAAAAATATATGAACCCAACAGTAGTATGCCCTTAAAGGTGTACCATGCTTCAAAAAGCTTCATC

AACACATGCGAAATTCTGAGGAACTCTATGCATTCTGCACTCTACTTTTTCACGAAATGCCTCCATTTCAAACCAAA

TAAAATGGTGATCAAATCTTCAATACTCTCACTATTACTTTCCTATATATCAATATTCTCACTTTCTAAGGTACAAAC

TATCAGGACACTTCCTTTTTTCTAACAAACCCATGATCACAAATTTCTTGAAAAATCTAATAAATTCAAAAGGTTCAT

GAGACTGCATTCATCCAATTCTAACAGTAAATAACAGGAATAAAGGCCCATGGTTCAGAAATATTCAATCAGCATA

AGTTATTACAACAACAAACCTTGTATAGCTTCTTCCCAGAACCAAATTAAAACCTTTACTCTGAATTTGAAGAACAA

CTAGCAACTGCGTATATCAGTATAGCTTTGTTCCTTAACTGGCCCTGTGCAATTTGAAGTTTAGCTTTTGTTCGCAA

CAAATCACCTTGATCCCATATATCGAAAACCTCCTTTCACTGAAAACCTCCTTCCAACAAAAGATCCAGAAGCACTG

TGTCACACACTTGCACAGTCGCACTCCAACACCGAAAACCTCCTTTCACCGTCGCACCCCACCGTAGCACTCTAGCA

CCGACTGCATCACAGCAAGAAGCCAAGAAGCATGAACCAAACAATTTTGCACTTTGCATAACTCGAACAAGGTAGA

CAAAGTCTACTCAAATAAGTAGCTACAACACGACACCGTTTCGGGTTTTCGTAAATCCACATACTCGTAGCAGACTC

GCGAGTCTACCCAAACTCGCCCAAGTTTGCGCTAAATCAGATGAGTCTATTCCGTTTTCAATTCTGCTTTCGATTTAA

CTCGCTGAAGCTTAGTGGAATCGTAAAATCATACAATTCTACGATTTAAAACATGAGTTTAACAACCTTGGATGATT

CAAGTAAAATAATCCTACTAGAGATCTTATGTGCAAATGCAACGAAACACACATAAAAGTACATATTAAAGATTTAA

CAATATCATAAATTTAAATAATTTTAAATATGATAGAGATCACAAATATCATTGATGGGATACAATCTTACTCAATGT

CATTATGGACGTCAATGTTCCTACCCTGAGTAGTTAACACAAATGCAAACCAAAAAATTCAATAATAATTATTTTTATT

TTTAAATTCTATAAAAATCATTTTAAGTAAATATATAATAGATATATTAAAATTAATATATTAGTCCCCGTTGATCCTT

GTGTATGAAATAAATTGGGTTGGGAGGGGAATAGTCAAATTATGTGCACTCAGAATTCTTGAGGAAGATTAGTCACT

TAGTATTTTTATTTTAAAAAAAATTAAATTATTTACTAAGAAATAGCATAAATTAAATTAGTTTTATTCTCTTTGGGAT

AATGACTAAAAATAATTCTTCTTATGGGCCAACCATTATAGGAAAAAAAAAACTCTTTCGCGAGTAATTAAAACAAT

TGCATATTAAAGACTCAACAATTTATTTTTAATTCGAAATTTTATAAAATTAGTTTTAATTAGAAATCATATAAAATA

AAATTAAATAATCTTATAAATAAATATTTTATTCATTAATATTTATATTATAAGGTTGAAATTTTTATACTATAAATAA

-continued

ATTTAATTTTAATTAGTTAACAAATTTATTACAAAATAATGTTTGACTCTATGTTAAAAATTAATTAATTAAATATAT

TTTTATTAAAACTAATTTTAAATCATTTCGTCAATAATCTCATAAACTTAATTAGTTTAAATATTTTTGTAGTAGAAAT

CATAAATATCATTCATAAGAAAAAATCCTACTCGAAATTGGATTATTATATGCAACAAAACTATTTCTTCCAATATTT

TATAAAACTACATACCAAAAGACTTAATAATATCATATATTATAATAATTTTAGTTATGCTAGAGATTACAAATATGA

TTAGTGACAAGAAAATCTTGCCAAAGACTATTATAGACCACAATATTTTTTTATCCAAGTAGTTAACACAACTACA

CATAAAAAAAACTGAAATAGTATTTTTTTTTTACTTTCAAATCTTATAATATTATTTTTATTTGGAAATCATTCTTAC

ATAATTATATAACATTTTATTAAATATATTTTTATCACAATATAATTTTAAATTACTTACTCAATAAAATCATAAATTA

TATTAATTTTAATTTTTACATAATATGTAGTAATAAAAATATTAAAATCAATTTATAAAATGTATTTTTATTACAAAAT

AGTTTTAGGTTACTTACTGAATATGCTCTTTCTTCAAGTATTTCACACAAATTCATATCAAAAACTTAATAATATCAT

AAATTAAAATCATTTTAATCATGACAGGGATCTTAATAATCATTGATGAGAAATAATCCTACTCAAAATTATTACAA

ATGACACAGTTCTTTCGCCTAGTAGTTAACACAATTGTATATCAAAGAGTAAAAATAATATTTTTTTTTTAATTTGAA

AACCCATTTTTACTTTATAATCACTTCTACATAATATATAATAACTACTAAAATTTAATTATTAAATATAATTTTTAAT

ACAATACTTTTAAAATACTTACTCAATAATACATTTAATTAATATATATTTTTTATGATAGAGACCAAAAATATCATT

CATGAAAAACAATCACGTGTTTAACGTCATTACAGGCCAATTATTATGGGTGACAAAGCTTTTTCTTTAAGAATATTT

AACATAACAACATATTAAAGAATCCACGATATCTTTTTAAAAATTTGAAATCCTATAAAATCAATTTTACTTAGAAA

CCGTATAAAATAATTTTATGAATGAAATATTTTTTGAATAATTTATGTTATGTAGTTGAAATTTTTATACTATTAATTA

ATTTAAATCTAATTAGGTAATATCTTTTATTACAAAATATTATTTTGTCTCTTTTTTTAATAACTTCATATATGGAAATT

TTATTAACTAATATTTATAAAATAAGTTTAAATATCATTTTTTCATAATTATATAAGAAATATTTTAATATTAATTTAT

TAAATATATTTTTATAACAAAATATTAAATACTGAATAATATCACAAATTAAATTAATTTTAATAGTGTTGATTTTTTT

ACATAAATACATAATAAATATATTAAAATAGAATTTATGAAGATAAAACAGGTAAAAATATGAATAATAGTTTCAAT

TTTCAAATAATAGAAGACAATGATTTAAATAGCCTAAAAATTAGGATTTTGATTTTTTTTTTGCTTGAATATTCTAATC

CTTTTTTCATGTTTATTGAATATAAATACTAAATAGCTAATTATCTTTTTTAAGCAAGTGTATTTTGAATATGCGTAAA

AAAGGAGAGCGATCTGCGTAAATGTATGGGTATCTTGCTAGTTATTAACTTATTGTAAATGGAGATATAATATTGAT

GGGATGGTTAAAAAATTATGAAAGAAAAGAAAATTTGTGACTTTACTTCCTTATACTAACAAAAACTCACAAAATAA

CGATTAAAATTTATCAATTAAAAAAACTTATTATAAATTCAACTAGAAAACAACTTTAATTTCAGTGATATTCGTAAA

TGGCAGACAACATTTCATCACTTCACTTTAATAAAGGATGCAAACTTGCAGTAGTAAGGGAAAAATCAAGCTTATTA

AGACATAATTGAATAATTGAAGTTTATTTCAAAATTAGTTAATTTAATTATGGTAAATGTTAACTAGTGTTTTTAAGG

TATTAATTGGTTATAAAGAACTAAAATAATAATTTTTTTATTGAAATATATAAAATAGTATTATTTATGATTTTTTTA

CATACTCTTATGATTTTCATAATAAATATTTTTTTATTTAATTTATTAACTAATGCCTTAGGGCACTGATTAGCAACA

TCCTTTAGGTTTTAGCAACCATTAATTGATTTTTATTTTTTAGCCATTGAATTTTTCATTTTAAAATTATTATAAAATAT

TAATTTATTAAATCAGAAACTAAAAGAACAATTTATCAAAATTCAGAGATTAAAAAAACTTTTATAATTTTAGTAA

CTAAAAAAATCTCAGCCCAACAATAAAGAAAAATAAATATAAACAATTTAATAGTAAATTTAATAATTTTTTGCGGT

GATCAAAGATATGGTTAAAATGGAAGTTTGTTGTTGACTTAATACATGCCAACAAGGTACTATGATGGGTGACATGG

CATGTGAAAAATTGAACTCTCACGTCCTTGTTATGTCAATCTTAACATCATATCACCAGTCTTGTGTTAGCAAAAATT

TCTTAAATATTTATAAGAAAATTTATAGAAGAATGAAAATCACCCAATTGTTTTGGGATCTATGCAAGCAAAAGTAT

ACAAACAAAACAACATATACAGAAAAGTACATACACACCATTCTAGAGAGGGTGTGCTTATTTAATTGCCAACAAA

ACAACATATTATAAATTGAGCATGCTTATTTCAAGAGTAATTAAATTAACTACCAATTTGATATCTAGAGTATTACTC

TTTCTTATAAATAGTCCTTAAAATAACAAAATCATATATAAGTAATTTCTAAAGTGTTAAATATCCATTAATGCATAT

ATACATTGAAATATTTTATCAATGTATAAGGATTAATTTGAAGAATGTTTCAATACTTGAAAGAATTAATTTATATTT

TATTTTAGTGACTATTTAAGAGATGAAATTGATAATTTACGCTGGTCTTATTTGGATTCCTCGAACTTCAATGCTGCT

-continued

CTTGGGGTTCTCATCAGTGACTATTATAGAACTCACCCAATCTTACCTCCATCCACCCATCGTTTCTCTGCACAGAAT

GTCCATGCAAGAGTGGGGATGTCACGGAACGTTAAGGGACACCTCAACAGGCTTGTTCCTGAACCCGGTGGCATTA

TTCCTTAGCCTAAACACTAAGTATGCCTCCTATACCGGAACTTGTTTCTAATGATTATTTTTTAAAAAAAATAACAAA

TTAACATATTTAATATATTAAGAATACAATGTATTTGAAATAAATTAATTTCAATTCTATGGTACCAAAAGTAACTGG

ATTTGAAACATGTTTCAATTGTTAATATTTTGGTACAAGGAAAATTTCCGAGATAGCCAAAACTGTCAATTGAAACCT

TGAGATACCATAAATATGACCCAACATAATCATATATCATATATATACTCCTAGGAAAATATTTTTTACATGAAATA

AAGTCTCCTCATCCTTGCCATATGAGGAACACTACCTGACAACATTGCTGATTTCAAAAGCCTTGAATTCTTGGATAT

CTCTTATAAACTCTTTTCCTCATCCTTGCCATTGGGAATTGGTAAATTAGGGAGCTTGCAGAATCTCTCGTTGGCTGA

AAATAACTTCTCCTAACTCTATTTCAGAAATGGCCTCCATCAAGTCCCTCAACTTGACTTGCATGGGAATATGCTTCA

AGGCAATTTGGATTAATAAATTACTCTAGAACCTGAAAGGTTAGTTAATTCACAATTTTTTTTTAAAAATTATTATTA

CCAAAATTTTATGATATCATTGATGTTTATATTTTTATTTATTATATATATATATATATATATATATATATATATATAA

AAATTATTACATTACTTAAAAATTATATGAAAAGTAAATTTAATTAAATATAATATTCAGTAACTATTCAAGTATA

TATAAATATAATTATCAACTTGTATAACAGAGATATACTTTTAGCTTCTTTTTAGAAAATATTACTATTAGCTTTAAA

ATGATTTATATATATGTGATATTTTAAATTACATTTTTTGGTAAAATATTTTAAATTACTTTGTATCACAGTTATTATA

TATCTTTAATATTTTTTTTTTGAAAAAATAGAATTAAAATTAAAACTTAAGATCGAGATCAATCCAAACTTATTAAAT

CATATTTAAATTTTAAACTACATCAATTGAACAATGAATTAAGAAAACCAAAAATTGTATAAGATGATATTTCTCTTT

TTCAAAACCAATTTAATCTACTCTATAAACTCCTCTTAATCGGACAACTATTAGAAAAGTGAAAAGGAAAATATAAA

AAATTAAAAAAGTAAATAATTCGACTGTAGAAGTCATAACCACATTCTTTATCATCCTTCTCTTCTCTATCCCCTC

ATTATTGCACCTGACACATTTGTTTAACACGTTGTCATATTGTCTGATCAATAGGAATATGATATATCGCCTCTTTATT

TTCTAATCATGTAATTGCACTGATTATTTTCTGTTCTTATCATGATTGGTTTCACATTATTATTATGTCATGCACTTCA

TCATGATGTGTTGCACTAATATTAATGATCGTTCTACAAATCTTGTTGTACCCCTTAAATTTCATTAGCTTCTGTCTT

TTTTTTCTTATGGAAATTAATTAATTAACATTGATTTTTGAAGTGCTTGTTAATTACAGGCACCATGGAGGAAAGAGT

GGGGCTTTTGTTTCTGATTTTCATGCAAGAGAGGTAACAATTGTTAGATTGGCCTTTTTCTTATCTTTTTTGCTTTTA

AATTTAATTATCGTGCTAAGTTAGATGGATATAACGTAGTTACAACCTCACACTAAATTTACTGTACCATAATAAAGT

TTACCTGGTTCTTGTAGTAAAAATATAAATAGTGATGAACCACATACCTTCTAAAACCATACCCATACCTGTTTCATA

TACCTAGTAACTTAGAGATAGAATGCAAGGCTTGCATTATTCACTCTCCTATATATTTATTTACCAAACTTTGGTGGA

AATTTTAAGGAGTGACAGGTTCATATTAGCTTTTAACCATCAATGGAAAACTAGAAAAAAGAAAAAGCTGGCACTA

ACAACCAGTTATTTGTCAATAGGAAAGGAAGCTTGGGCCCAATTGAAGGATGTTGTGGAAAATTAGTGTCTCTTTGA

TTTCAGAAGCTTTACTTTTTTTTTTTTTTCCAATACTTACAAAAATATCATCATATTTTTTTACCTCATGTCATGATTTG

AAGAATGTGTTTTGCTACAAAGTACTGATACTTTAATTTGCTTCATGCATCTATATCCGATACCAATATATTGATATA

TTTCACTGGTACATATATGTAAAGTGACCAATTCTTTTAAAAAAAAATTATGATAATCAAATATAGTGACATGTAAC

ATAGAAGTAAATATAATATAGAAATATAAAAAGTATTGTTTCTTGATGAACCAAATATGAAAATTGTTTTGTTTATAG

ATAATTTCAAGAAAGAAATGAGATTGATCATTGATAGTACCATTCTTATTTGTGAACAATAGGAAAAAATGATCTAC

AATTTTTGATTTTGTTTTTAGCAATGTCTAAGAAGTATGTATGTTCTTCAATTTACCGAATTGCAATTGTATATTTAT

TATGCTTTTATCAATTCTTACGTATCTACATATCTATCATATTTTTAGAATAATCATACCACTATTAATTTATAGGACA

GGAGATAAGAGATAAGCTGAAATCATCCAATCCTTCTAAAGTTCACTTGGTACACCTTTTCATCCTTCACATTGTACC

TAACAAAAAACCTCACAAATAAAAATTTAGCTATTGAGAAAGTGTCAATTTGACGTCAATTAAATTAAAAGTTACAT

TTAGCACTAGTCAAATTTGAACTTAGATTCATGGGTAGGTACAGTTTCTCCGGGCCAATCAACCATATCTGAAAAA

CAAAAATAAGTTTCCCACGGTCATTTTCACTCTGGCCTCAATAATCTTAAGGAGAAATTAAGTTAGAATATAACAAT

ACTGATGTGTAACATTTTTCCGGAGAATCATTATATTTAAGTATTTATCAATGTTGTTACTTAGTACCTGTATCGTTAC

-continued

TTCTCGAAACATATATACAAGGTCAATTTCCACGTTGCCTTTGATGATTTGTTGATTCTCTGTAGATTCAGTAACAT

ATATACAAGGTCAATTTCCATTTCAGAATGAATTGGATTTAGTAAAACGTAAAAGGAGAAAGACATGAAATGAAAC

ATATCCTTGACAGAACTAGTTTCTAGTTGGTTAGACTTAGAAGATACCTGTTGGTCCTCCTTGGTGGCTAAATCCAT

CTATTGTCAACCTTAATGCCAGGGATGTGGGAAATTTTAGGCCAAATTTGAGGGTGCTTCTTCCGGCATCGTTTTTTC

AGCAAAGGACAACTCTTTATGGTTAATTTTATTAGAGAGTCAGGAAGCCTTTCTCCCACCATATTTTCCAGCAAAGG

ACATCCGTCTATGGTTAATTGTTGCAGGGATGTGAGATGGAGAAGCCCCGTGCAGTCCAACATCTCCAGATTTGAGA

ATCCACTTAGATACAGATACGTAAGGGAGGGAGGCAGCAAACCCTCCTTAGGGAAGGACTTGATGCCATCACATCG

ACCCCCAACATAGAGATGAGTAAGCATGCCCATGGATGGCCATGCTAGGCTGCTCAGTAGTTTCTCACAATTGAAAA

TCCAAACTATTCTCAGGTTAGGTGGCATACCCCGTTTTGGAAACGACTCAATTTCTGGGCAGTTGGATATGAGGAGA

CGTTCTAACTTTGGGAGAAGAGTACTCATCTCATCAGGCAACGACTTCAACTTGTCAGAGCCCCACACTTGGAAAGT

AATCAAGTTGGGCGCAGGCAATCCTTCTCTCCAGAATGATACCAAAAGAGATTCCATATTTTCACAGTTTCTGATTTC

AAGATCTCTGAGATTTGGAAAGGTAACCAATGGAAGAGATGTGAGTGAATCACAACTGCTTTCTATTGACAGTGTTT

CCAGTAACTCATGTTTGTGTTGCGTCGGGAATTCCAGTTTTTTAAGATCCGAGATATACAGACTCTTCAGTGATTCAG

GTAAACGACCACCCGGAAATGACACGGCTGACGAGCAATCCCTTAATGTTTAAAGACCGGAGACAAGTTGGTTGGAT

GTTGTGATGGCCTCCATCATGGACTCCACCATTGGGCTTCCTTCTACTTTTATAGTTTCTACCAAGAGAGGAAACGC

ATGCAGTGCTACTTTATTGCTTTTACGTATCTCCAAACTTTGAATGGCGGGAGCCGTTGGGAGAGAAGAGCCAAGCA

GCTCACAATTTCTAATTGTAAGTGTTTTCAGAGCAGGAAGGTGATTCGGCAAACTTCCCTCTAGTTTGGGGCAGTCA

CGTATTTCAAGAATTTCAAGCACAGGAAAAGCTTCTGAATCGAAGGAACTCCACACCTCCCAACAAGGCATTTGATG

AATGGCCAGAGATTCAAGGGAGGGAAAGGGCGTCCCAGAACGACAATCTTCGTTCTTGTAAAAACCTGCATCAATA

GTCTTCAGCCTATTCAATCGTGCAATCTTAAGGACCTTGAGAGAAGGTAGTTGTCCAAGTGAAGGAAGCATACTACA

GTTGTCACAATCACGCAATTTTAGACTCATCATATTGCAGTAGGAAGAATTTCCCATCCAATCTGGAAATCTGGTTCC

TTTATAGCCTTTTATTCTCAACGATTCAATGTTAAAGTGAGGCTGTAACTTGCAAAGCACATCTATTTCTAGTTGGAA

GTTGGTACTGTTGTTATTACATCTAGACCATTCCAACCATAAACTATTAATGTGTTTTTTATCCATCATCCTTGCCTCC

GACGCTTCATCACTTTGGGAAACATTTCTCCAAGTTTCCTAATTTTAAGTCGACCACGAAGATTTGAAAGTCCTCCCAA

TTCTTTGATCCCATTCTCTTTTGTGCTTGCCCACAACAAAGAAATCCAGATGTTGTAGATGATTTAATTTACTCATTCCT

CTCGGCATCTCTTCTATAGGAGTTTCACGTATCTCAAGATGACGCAAGTTAACAAGATTGCACATGTCACTAGGCAA

CTTAGTCAGCTTTCTGCAACTACACAACTTCAAAGTTTGCAGATTGTATAAATTACACAATGACTTTGGCAGTGTTTC

TACACTTGAATGAGAAAGATCTAAATAGCGCAGATGGATCAATTTACCTATTGAATCAGGCAAAGAATCCAAACTTT

GGAAGTCACAAAATGATAAAACTCTCAAGTACATAAGCTTCGACACAATGATACATTGTGCCTCCTCGTTGTTGAAT

GGAGCAGCTTCAAAATTGATAATGGACAAGAAAGTTCTCAGAAATTTTGCTCTACCAACAACATCAAAGTTGTCCAA

GACTGAAGAATTGAATTTGGTAAATGACAAATGACGAGTCTTAGTATTGATCTTTGTTTCTTTCCCAAGTTCTTCTGA

TCTAAAATAAAAATCTCCACCGAGTGATTTGGCTAGATCATGCATGAGGTCATGCATCACAAAACATTCACCATAAG

GCCAACTACTTCTATTTGTACTTGAACGTTGGAAAAATGATCTCGAAACCAAATCATCAAAATACTCATGACCAACC

TCTTCTAAAGTCCTACCTTTCCTTGGTTTCTTCAAAAGATCTTCAGCCATCCACAACAAGATTAATTCATTTTTATCA

AATTCGTAATCTTGGGGATACAACGAACAATAAACAAAGCACCGTTTTAAATGTGGAGGGAGATAATGATAACTAA

GTCTCAGTGCTGGAATAACTTTACACTCACTTTCAGAAAGTTCCCAAATGTCACTATTCAGAATATTATACCAATCCC

CAATGTCATGCTTTCTTCTCAACATGCCTCCAAGGGACTGTGCTGCTAAAGGCAGTCCATCGCACTTTTTAACAATCT

CCTTTCCAATTTTTTCTAGTGTTGTGTTCTCGTTCGATTCCAAGGAAAGACACGCATGGTTCGCAAACACTGACCAAC

AATCTTCATTCGACAATTGGTTTAGATGATAGGTTTTGAACCGTTTGGACTACGGAGGCTGTCTTTTCACTGCGGGTTG

TTAGAAGAATTTTACTTCTCCTAATAATCCCACATTGAAATGGTTTCTTAAGAAGACTCCAATCAACATAATCCTCTG

-continued

TCCAAACATCATCCAAAACAATTAGGAATTTTTTATCTTTCAGCTTGTCCATCAATTCAAGATGAAGTAGATTCAGAT

CATTCAATTTACAAGGATTTCCAGTAACCGCCTGTATTATAGTTTTTGTGACCTTCAGAACATCAAATTCTTGAGAAA

CACAAACCCATGCCTTAAAATCAAAATCAAATTTCTCTTTCAAATTCTCATCATTGTACACCAATTGGGCCAAAGTA

GTTTTTCCAACCCCACCCATGCCCACAATAGGAACCACAGACACTTCACTACCGTCACTGTTATCCTCCGACAACAA

CTTGATTATGGCCTCCCTATCTTTCTCCCTACCATATATATGAGATCCATCTTCCAGAGATGTTGATGGAGCTTTCCA

TGACAAGTTCTCCACTGCACTCTCTTTCAAATCAAGACTCTCCTTGAGTTTTAAATGAGACTCTAGGGTGACAACTAT

GTCCTCCAACTTACTAACGATCTTCCGATCGGAAAAGCGAGAAAACAAGTTTCTTACCTTGTTTTGGGTGGCAGCTTT

GGTGAAAACATGGTCGAGTAAGTCATCGGCTTCATAGACAGCATCTTTGAGAGCATTGAGCCAGTGTTTGACATTGG

TGTTTGTGATCTGTTTCTTCTCGGCATCATCAAGCACAGCTCCAACCACTCTGAGAGTGGTCTCCAACTTTCGAAGCA

ACTTCTTGCTAAGCTTCTTTCCAAGGATCAAGTCAACAAAGTCAGGTGAAGCCAGCCTGTCGAAAAGCACATCAAGG

AAAGCAGAGAGAAAGGCACCACCGACCAGTGCTGCAGCCATTATCTCAAGAACAAAAGATGATCAGAGTAGAAAG

ACAAAGGCAAGGGAATGGTTGCTATGAACTGATGTGATGAGATTTGGCTTAAGTCAACTCTCTTCACCTTCACTCG

TTCTGCTGTGCAAGACAAAAGTATGGTCTTTTTTATTTTTATTATTTGTATTATTATGGTGGTGGGTGACTTATCACGT

TGGGAGTCTCTTTACTTTTGATCCTCACATATGTTACTTTCTTGATATTTCTATTTTGAATTTAGCTCCTCTAAACTAA

AGACTCAAGAGATTTAAAGAGTGATGATATAAACAACTAACACATGATGAGATATGTTATTGTATAAAGATCTGAAT

CATGATTTTATAAAAAGTTAAAATAATTGATAGTAATTTATGTTTTTTAATCAAGTGGTAAAAGATTTAAATCTTTATT

AATTCTTATATATAGAATAAATTTTGTTAGGAGGAAAATAAAAAAATGAGATTAAAAAATTATTAACACAATAAAAA

TGTTGAACAAATTAAAAGAGAAAGAATTAAAGAAAAGACACATGCTAATTGATCCCTAAAAACAATAATATATATT

AATGAAGTCAAGATTTGAATATCCTTATATGTAGATTAAAGATGTGTGCAAAAAGAAAAGTGTGTGATTTTTTTATTAA

ATAAAATCAATAAATACTAATAAAATAAAAAATATTGTGAAGATGTTATAATAATAATAATAATAATATAAAGAGAG

TGATTAAAGTAATTCTTTTGAAATGATGGCATGAAAAATTATTATTCAATTCAACTCTTTHTTTATGTTATATATCTA

TTGTAATTATTTGATAAATACTTCCATAAAATTTCTTGGTTGGTGATTATCCTTTGAATCTTATTTATATAAAAATTTT

ATTATTAATATATTCAGTGAGATCATCTCAAACAACAATAGTAAAATGAGAGATAAAGAAAATTTAAGTTCAGCAAA

TGAAAATATTTTACTATATGTAAAAAATATTTTTTCTCCTATCATATTTAATAAATATAATTTTATTTTAAATCAACAG

GTATAAATTTTTATCAATAGTTAAAATAGATTTAAGTGAACTTCCTAGAAAAACTTTTTATTTGTTTGTTTAAGTGTT

GAAGATATTTATCCTCTAACTTATTTTTTCTCATTACAATTATTTTTTTCTTTTTACTACCAAACAAAACCTTACAGGA

TTTTTTTACTCCACTACACTTGCTCTCTCCTCATTPTTTCCAAAATACACCTGCCTCAAAATTGTTTCCTAAACAACAC

TCCTTTTTAGCTTGCAGAGAGAAGTCGGGGTTAGGGAACCCAACTTCTCTTTGCTCCTATTATTTTTTAATTTAAAAA

AAATTATTAAATTCTTTTTTTATATTTTTTTAAAAATAATTTACTTGTTTTTTTAAATATTATTTTCAGATAAAAAAATAA

CTAAATTTTTTATTATTATTATTTTGTTTTTTAAATAATGAGAATATTTTTTGTTAATTATTTATTTTATAGTTTGAAAA

TAATTAATAATAATCTAAAATAAATTTAAAAAACAAAGTGATTAAAAAAATAGATTGATTAAAAACCCAATAAAT

ATATGATTATCACATCTTAATTATATTATATTAAGAAATTAAAATACTCAAATAACATAAAATATTAAAAATTAAAG

AGACAAACATCATAAATGGAACATATAATAAAGCAAAAATAACAGAATGGACTAACAATAATAATTGAAACATGAA

AATAATGAAAGCATAAACAACTAACACATGAATCATTCCCATTATCAACCTCATTTGATTATTAATCCTTGGGAAGG

AGACATGTTACAACCTACCATAGTTTTTTTACCTAACAACTATGGTATTCATTCTAGAAAAAAAAATGTGAAAATTTT

CGATAATAAAAACATAACAGAAAAAATTATTTCAATATATCTTCATCTTCAGTTTTTTCTTAGATAAATATTATTGTT

CATGTATTTTATTTATGATGTAATGTMTCCAGTATAAATAAATTGTTAAAAATATATATATAATTAGTTTTTATACAT

TTTTAAAAAAATACTATAAACAAAAAAATTCATTTATTAATTTAACTTGTTAAATAAAAATTTATTTTTTAAAAAAAGA

AAAATTAATTCCTTTATTTTTTTAAATATTATTTTTACATTAAAAATAAATTAATTTTTTAATATTACTGTTTTACTAAA

TATATTTTAATATAAAAATAATATTTAAAAAAATAAAGGAATTAATTTTTCTTTAAAAAATAAAAAAAAGTTAAATAT

-continued

TATTATTATGGTGGTGCGTGACTTATCAGGTTGGCCTAGATGCTAATATAGTAAAGAATATTGTGAAAAAGTTGTAAT

AAGAAGAAGAAGAAGAAGGCGGATACAAGCTAGATCTTACATAATGGTAATTAGGAAAAACAAAACCAGAGACCC

CCTCTGATAGGGAAGAGTGATAGCATAGCATACAAAGGGATGTATTCAGAAAAAATAGATGTGAATCAAGACATAG

CAACTACAGGGGTGTCTATAGCAAAGAAGGGTGTAAATCAAGTAGAAAAGGAGGTGCAAGCAGCAGTTAATACCAA

AAGAAAGATCTCGAAGCCTGCTTACCTTAAGGACTACGTGTGATCCTAAGGAATGATGCTGAATGATCTGTGCTAGA

AGCAAGGGAGACAAGAATAACGATTTCTGATTTCCTCTAGCACAAAAGGACAAAATCTGTTATGTAGAAATCAGTAT

AAATACAATAGCATGTAATAAGCAGCACGATATGAATGAAATTAGCAAATTACTCTCATCTCTGCTCTTCTTCTTCCT

CTGGAGGTTCTGGTGCCTCGAAGCCAGCTCTTAATTTCCTGCATTTATGTTCACTTTCGTAACAATTGGTGCTCTCGTT

TGTCCTCATGGCCTCACGCAACCTCGACAAGGCCCTTGTTCGTCTTGACAATACCATGCACTCTATGACCCTCAATA

TGGACAAGCTTCGCAACCGCCTTGCTCCTGTGCCTTCCTCCACCACGCCCAACCCCACACCAGTCCCTTGCCACTCC

ACCTCTGTTCCTGCACAAATCCGATATGCCTCATCACCGTATGAGGATCCTGTCGATGCCTTGTTCAAACTCACTCAG

ACGGGTTCAGTGCTAACATACCTGAAGGAGTTCGAAGACTTGGCTAATAGAATTATCGGCTTGTCGGCCCCCTTCCT

GTTGCCTTGCTTCATCTCGGGTTTGACGTCGGAGATCCGCCGCACAGTCCAGGTCCACCAGCCTATGACTGTGGACC

AGGCCGCCAGCCTTGCGAAGATCCAGGAGCAGAAGCTATCGGACCTTCGTCTGCCTCCACCGCGGCCGCGACCCCA

CCGTTGGTAGCTCCACCACCAGCCCCTTTGGTTCCCCCTCGTATCACGCCTTTGCCCCCTTTGCTGCCTTCCCCGCCA

TAGGCTCCGACCGTCAGGCGTCTCACCCCGGAGGAGTTTAGCCTCGCGCCATAAGCACGGGCTATGCTTTCACATTCGA

TGAGAAGTTCCATAGAGGCCATTGATGTGCCTCTAGGGTTCATCTCTTAATCGCAAAGGATCAGGAACCTGTAGACT

AGGGGTGGGTAAATGGGCCCAGGTCCATGGACTGGCCCGTGGCGCCCGCGATCCGCTCGAGTTACGAACCAATTTT

TTAAAACAGTTCATGGTTATGTCATATTTTTTGGTCCGCCCCGCTTAACCCGCGGACTATGCGGGTTTGGCCGCGGGG

TCCACGGGTTGCCCGCAACCCGCATTTGGTTTGATTTGTGTGACCCTGACCCAATTATATTAGGTTTGATTTTCTCTTT

TTCACTTTAAACTTTTCTTTTAAAATAACAAATGAAGAAATATATTATATAAGATAAAGATTTAAAGGTAAAAATAA

AAGATTTAAAGGTAAAAATAAAAGATTTAAATTAAAAGATGGTAAAGATAAAAAAGATAAGATAAGAAAAATAAAA

GATAACAGAAATAAAAGATTAAGATAAAAAAATATAAGTGATAACATGCTAAAAATCTTCCTTTTTGATATTTTCTC

GATCTTTTTCTTTTAATCTATCATTTTCATATTTGCAAGTCATAAATAATAAAAATATCAATTCTTATCATTTAAGC

TAAAAATAATTGTTAAATAAATATTTTTAAAGATATTTCAATATATTTTTATTATAAAAAATAGTTCACATCATATTTA

ACACTCTTTCCCTTACAAGGAAAACAAAACGCGACTCATATTCACGCAGTCACGCGACACACCACAGCGACACAGC

TTCGGCCCACCACCGTGCCACCACGCAAAGTACATCTCTTCTCTCTCTAGAATTTGTTTTTATCCTATTTTTGTTGGG

ACTGATTCATTTTTGTTGTACTCTTAAATGTGGAGATGGAGAATGTTCAAGCTACTTCAAATATGGAATCATTTATTG

TTAGAGATGTTTAAATTTCATATTTTAGATTATTGTTTGGATTTTCTGTTAAGACATTATTTATTTTATTGATGTA

ATTGACTAATTATTGAGATTTATTTACATCTATATTAATTAATTATGTTGCACACATTGACATGGTGTTTTTGAAAA

GTCAATCCAATAAACTATACCAGTTTTAGTCCAAATGAAATGCAATTACTTAAAAATGATTGCACAAATGTTTGAAC

CTAGTATCACCTGCAAACTACCCAAAGACCTTGTCACTAGCCCACTACCAGTGGCACGTCCAATATGATGAGCTTCA

ATAAACATTAAAACATCATGTTAAAATACAATAAAGGAGATAAAATGGCAAGGTGTCAGCCTTCAAGCATAAATCA

ATCTGCATTCTGCAAGCAAACATCAAATCTCCTTATTTGTGCCTTTCTTTTTAAGTCATGCAATATTATGTATCGTTTA

CTGCTAAGCAAGATGAAAGAGCAATCATAACATCATGGGTCAGTACAAACAAATATACTGCAAACCGAAATGCAAC

CTTGTTTACAGCCCAATGCTTCTTTTCAATTAATTTCATTCCAACATAGCATGTAAATTGAACAAATTAAAAAAATTA

CTATCCATAACATCTATTTCGATGAACTATCGCATAGCTAATCTATTTGTTCGGGGTCTTGAAGTTAAAGCTTGGAGG

ACAAAACAAAGTAGTGTACAAGTACTTGGTGCTATGGCATACCGTGCTCCTCAACATTTGTCTCGGTGTCTCCTTAA

GATTGTTCCCAAATTGACTGAGATATAATATGAAGCAAACATTATTTTTCACTTCTAAATTCCTTTTAAGCTATAGAT

TGCATTACCTTAACCCATCTCGGTATTTGAAGGTTTTGACTGATACACATCCTATAGTCAGTCAGCTGGGCAAATGGC

-continued

CCCTTCAACACGTTAGTCTTGACTTACAAACTATTCTATCCATTTGATTCCTGCTTCTGTGATTAATGTTTTTTATTTC

ATGTTTTTTCAGGTTGGGAATGTGATAAAAAGTTCAGAAATATCTGGTCTTGTCCTTACTCTACTTAAGTAAATTGG

TGTTTTCGGTATCTAGAGGGAGGAATAAAAGTAATTCTTTTAAAATTGTGGCATAAAAAATCATCATTTAATTCAACT

CTACTTTTATATGTTACATATTTATTGTAATTGTTTGATTTATATTTTATGAAATTTCATCCTTCAAATCTTATCTATA

CAAAAATATTACTGTTAGTTAAGTAAAAAAAAATAATGAGATTATCTCAAACAACAATAGTAAAATGAGAGAGAAA

GAAAATTTAAGTCAACAAAGAAATGATGAGCAAATGAAAATATTTTATTATATTTAAAAAAAGATATATTTTTCTCTT

ATGATATTTAATAAATATAATTTCTATAAAATATTTTTTTTTATTTTAAATCAACAATTATTATGAAATATAAGTTTTT

ATCAATTGTTGAGATAAATTTAAGTGAACTTGGTATCAATGATTATTGTGTAGTTAAAGTCCTAGATCCAACTACTCA

TAAAAATTTAAATTTTCTTTACATGTAATATAAATAGACATAACTCTAAAAATGAAAACTTTTTTTATTAGTTTGTTA

AAGTTTTATAAATATTTATCCTCTAATTATTTTTTCTCCTCACAATTATTTTTATCTGCTGTAAAAGATAAATTATAA

TGTATTTTCTAACAATTTTAATATACTATTATTATATTTTTATTTAATATTTAAGAATATTTCTATAATTTAAACTCATG

CACTAAGTATAAATTATATTTGTTTCCATGACATTAATACAAAGTATTTATTAATTTTATATACTGATAACTCATCTTC

ATAGAGAAATTTAGTTATTCATCTTTAACGAAGTCACTATTTTCAATTATTTTTAATATGTAAGACTTAAATCTAAAA

TCTTGGCTCAAGGGGATTTGTCTTAACTTTTCAGTTCATCATGGGAAATGATGCTAAAGTCACAAGCTAAGTAAAGT

CTTACCAATAATTATTTCTGTTAAGCCGAACTCAGGTAATATTCAAACGATTCAACTTTATTTTAAATACACTAACCA

CTTGTACTCAGTCACTTAGTCACTTGGTTGCAACAGATTTTAGTTTCACTCTAAGCAATAACATGTTGGTCACAAGAAT

ATATATTACATATTAACTTTGAAAATAAAATATAATAAAATTTCTAACTCAACTTTTTAATTTTCTTATTTTCATTCTA

ATAGTATGGTCACTCATTGTAATGGCCCGCCTCTTCGTTACGATATCACCACTCTAAACTGCGAAAAATTTCAATTTT

TAAATGAAAAACTCCATTAATTTGCTTATGAAAAATTAAAGTAATTTTAATTTCACGATATACATTCCGAAACAACG

CATCATTACTTAAATGAATACATACATATATATAGGCATAGTAACTTAGTACACATCATTCACACAATGGAAGGTAA

ATTTGTTCATACATATAATTAAGTTTGTGATTTACATCCTTAATTCAACAAAAAAATTATGGAACCAACTATGAAGGA

GTTGATTAACAAAACACAACTCTCTCTCAAAATAATCTCAACGTCATCACGTCAGTTCGGCGACTTCACATCAGAAT

CTCACTTTCTGCACCTTACTGCTGTCATTCTGCTCCCACGAACAAGGTTCGCGATCATCACAAGTATCAACCACACG

ATACAAAATTGCAAGGGTGAGTTCATTATAAAAAGAACTAATACTAAATTCAAATAACCACAATTAGCAAGAAAAC

ATTAACAAATATCATGAGCTTATACAACATTCATTAATCAACACACACTCAACAAATAGTCATCATTCATACATAGT

TCCAATTAATCATGTTCAGTATGATGCATGCACCTGATCTCAACTCTTAGATGCAATGTGGTACCATCCCCAAGGAA

ATAGCATAAGCGTGTCCACACGACACTCTCACTTAGAAAAACAAGACAATAAGTGTCGAGGTCATCCTGTCGTACA

CATGCAACTCTTTAACCACTCTATTTTCCCCCACCAAGGACATCCGACAAAGTCAATGCACCCCCATGAACATACAC

AACATACAACGTATAAAATGTGGGCACCATCAAGTACACTGACCATGAATGAATTAAAGATCCTAAGTCATCCCCTC

AGAGATGCTTAAACTCTTTAACCACTTTATTTTCCCCTACCAGGGACATCCGACAAGGTCAATGCACCCCATCACGA

ACATACACAACATGCTTCATCTCAACGCATTTCCAACATCATCAACATCTCATTTCAATATCACTCTCAACATCAAC

ATCTCATCATCTCAATGACATTATCAACAACAACCACATCATTTCATATTAACATAATCATCAATAATAACATCAATT

CATGTTGACATGATCATCATTAACAACGTCATCTCAAATCAATATCATCATAAATGTCAACATCACCACATATCAAT

TAAATTCATCAATAACAACATCAACAATAAGTCGCATTATGCATATACATATATCTTTCATGTCTGAGATTCACATTC

TCTAGGATTTCAAACAACACAAGTCTAATCAAGACAATAATGATATTCATCAATAATAGATATATCGCATCTCACTC

GTCAAAAACATTGTTTTCTAAAAAAAAAAATCAACATATAGCAGGGACAAGCATATATATATATATATATATATATA

TATATATATATTACATTGCTTAAAATTATTTATGAAAAGTAAATTTAATAATTATAATATTCAGTAACTATTCAAGT

ATATATAAATATAATTATCAACTTATATAACAGAGATATACTTTTAGCTTTTTTTATAGAAATACTATTAGCTTTA

AAATGATTTATATATATATGTGATATTTTAAATTACATTTTTTGGAGAAATATTTTAAMTACTTTGTATCACAATTATTA

TATATCTTAAATATTTATTTTTTAAAAAAATAGAAATAAAATTAAAACTTAAAATTGAGATCAATCTAGACTGATTAA

-continued

ATCATATTTAAATTTTAAACTACATCAATTGAACAATGAATTAAAAAAACCAAAAATTGTATAAGATGATATTTCTCT

TTTTCAAAATCAATCTAATCTACTCCATAAATTCCTCTTAATCGGACAACTATTAGGAAAGTAAAAAGGAAAATATA

AAAAATTAAAAAAGTAAATAATTCGATTTTGTAAAAGTCATAACCACATTCTTTATTATCCTTCTCTTTTTTGTTCCCT

CATTGTTGCACCTGGCACATTTCTTTAACATGTTGCCTTATTTTCTGATCAATATGAACATGATATATCTTCTCTTTAT

TCTGATCATGCAATTACACTAATTATTTTCTGTTCTTATCACAATTGGCTCCACATTATTATTATGTCATGCACTTCA

TCATGGTATGTTGCACTAATATTAATGATGGTTCTACAAATCTTTGCTGTACCCCTTAAATTTCATTGGCTTCTGCCTT

TTTTTTTTCCTGGTAGAAATTAATTAATTAACATTGGTTTTGTTAATTTTCTTAAGCTCATCAAAATATTCATAGAAAT

TTTATAATATTTCCTACATAATCTCGTAAAAAAATTGTTTTGCATAAATTAACTTAATTTGTATTGTGTTTTTCCCGAT

TCAATAGCATATGAGAGTACAAAGCCGTATTAAAAAAAAACTAAACAGTGTTATTAGTAAAGTGGAAAATATGTATT

TAAATATTATAAAATAATTAATTAAGAAAATAGTTAACGAATGAATAGTATAATTAATTGCTTAAAGTCACCTATAA

AAATGATATTATTAATATTATTGTATTTAACTTATATATTATAATTTTAGTTATTTAGGCTTAGGTATACCTATAATAA

AAAAATGTTATAGGTATAGTGGTTTAATAAACACTATTAATGTGTGACATGGGATTGAATCAAACTATAACATTTTAT

GAATGTTTTCATCATTTTAGTCTACATCACTTTAAAAAACTAAAATTCTATCATTATGCAATACAAAAAAACTAAAAT

GACATGATTATAAAACTCCCAAGGACTAAAATCAAACAAGTCAAATTAAAAATCAAATAAGATGCCAAATTAATCA

CTATCTCAGTTTAATGCCAATACCATATCAATCAATGCCGCCAACTATCAAAAGGATTAAAATCTCACACTTATAAT

ATTCAGGAGACTCAATTAATTAGAGAATAAAATTATATTATAATGATACATGAGAAAATAAGTATAATTAAGTCAAA

TTTTTACACATAAAAACTTAATAAAAATCATATGTCTCCTGGTAGAAAAAGTCTTACTCAAAATTTTATCTAGTGTTG

ATTTTTTTTAATGTATCAGCGTTGAATTTAAGAAGTATGTACATTTTTTTTATTTAGTATCACCATATGCAATTAGGAT

CTTAGGTTCCCAATAATATTCTAATGTATGTTCATAAACTTTGATTATTTGAATTAATTATAAGATTAATTTTCAATTA

GAAGTGAGACTTAATTATACTTAAAAATTATTATTTTTTTCAAAAAGAATGTATTTTACAAAAATCAAACTCAAATTC

TAATCCATAAACTTAACTTATATTATCAAATGACTTATGTTGATTAATTCTATCTCCATATTATGCTTTAAGGTCACA

AATAACACAATCATGCGAGAAAGAAAAATAAATAAATTTATTGACGATCAATAGAAATTAAATAGTATCAACAAGA

TAAATATGTTAAGAAAATAGAAATATAATTTTTATTAATATGAAACTGTGAATAAATATATCATCTTCTATAACATTA

TTTCATGGTTATTGATAATAAAATATTAAAACTGAATCACAACTAAAAAAATAATATATATATATATATATATATATA

TATATATATATATATATATAAAGATTTAGAATTAAATTTAAATCATATTTAATGTCTATCATTAATGAATTATAACAA

AATAAAATGTCTTTTGATTATCATAATCATTATAAGGATGTTGAAGATAACACTTTCGGCCATCGCCAATTTGAACAA

AGATCAACCGATAAAATCCGCGAGATATTTTTGGTTGCGTATTACATAATCCATACGTAATGTTAGGTCATGCGCAA

ATAGTAAACTGTATTCGAATACTATCTCTGTGTATTTTTAAATTTATCTTAAGTTAAAAAATTTATGTTAACTTAAAAT

AAGATACAACAAAAATTAACATACTAGTTTGCAAATTTATTTTGATAAATAAATATATCATAAGATAATGTACAAAT

ATTTAAACATAAAAATATTTAAATAATAAAAGATAGATTTAAATGTATTTTATATTTTAAATCCAGGCACAGCAATC

ACGCGTGCGATTGGCACTAACTCAGATGGAGATGGCTCTGTCATTGTCTTTTACCTGTCGACTCGACGTGATTCCTTT

ACTTTTGCGTCACCCTCGTCATCACACAACACACTCACGTCATAATAACTTCTACTTACTCAACTGAAAAACGTGCTT

CCAACTAAAAAAAAACCATAATACTAGTAATTAAGTTTTCCAACCAAACACATTAGTTGAAACTCTGTTAAAAGAAA

ATATTAGTTGAAGCTTTTAAGGTTTAAGTAACAGTTATAACTGTCAAAGCTTTTAATACTAATATAAAAATGTTTTTC

CGAATTACTACTATTATGTAAATATTATTTTTTTCATTGCTATGTTATTTGTGTTTAATTTGTAGACGCACTTAATGTA

AAATGTTTTTCCGTATTATTATCTAAATATTAAATTTTAATTGCTTTGTTATTGGAGTTTAATATGTAGACACACTTGT

TTAGTAACTTGTACACTCACTTATTGTAAAATATTTTTATATGTTTTTGTACAAAATCATTTTATCGCTAGATTATAATA

ATTATTAAGATGATGATGGGATAAATTTCCTCTACAAAATTGATGTGATAAAATAATTAAACCCTATTGAATATTTCT

ATCAAAATATTTTACAATAATGAGCATTGATTAAACTTATGATGTATATTATTACACGTATAAAAAAATTGGCGTATT

ATTATGTATGTGATAATCATACAATTAGAAATTTATTATCGAAATATAAAAAAACTAAAAAAATATATTTATTGATTA

-continued

ACATAACATATGTTTGAATTAATTTTATACAAAAAAAGTTAGTAGCTGATTTATTATTAAATAAAAATCATTTTATTT

TATCACATGTATAAATTAAATTATTTATAACAAGGATTTTTACTTTTCATTTTAGTTTCACAAGTACAACCTGTAAAA

AAAATAATTAAATGTTTTATTACACAACTTATGTAAAAAGCATAGATTTTGGAGGAAAAGTATTATAACTACATGAT

TTTACTAGCATATATTGTAATATTCTTGTTATCTGTGTTTACAGTGTAATATAAATATAGATATAGTACGGATACAGA

TAAAAGATAAAGATGAATATTATTTATACTTCAATGTTCGGAAGGTTGACCAATATTTAATTGGGTCCACATAGAAA

TCGAAATTGGACGAAAAAGGGCAAACCTCTTGACGGGTGAATACGTGCTCCTACGTTGTGGCTAACAAAGGATACT

ATAGTAAATTCATCAAAATAACTGTATCTAAGTGGCGCATTTTCCGGTGCTAGCGGTCGCATTTTCCATTATACGCTA

TATTTCTGCGTATTTATCTGTTCTTTTGGATATTTTAATTTGGGTACTTTTTTTGATGAATTTTTTAATATGGGTACTGA

TAACGTTCAACCTAAAATACCAAAATAGGGTGCATGAAAACATTAAAAAGAAGAAATTTGAAAGAAAAAAAAAATAC

TACTATAAAGTGATACGATAGAGAATGAGAAAATTACTTTAATGCTTTTGATAATTAATATTTTAACTCGTGTATAAT

TTATAGGTATTTTTCACATTTTATTAATTTTAAAAAATTTAAAAATAAATACTAAAGATTTTATTTTATAAAATAAAT

AGCATTCAAAAGATAAGGAAATATATTAATTATTTGTTATTATATATTGTTTATAAAAAGGTCATGTGAATAGTATC

ATCAAGAAAAAAATCAAGCTTTTATCATGTCAAGAAATTCTTTTATTACTTAAATACAGTTTAAAAATTAAAAAAGT

ATATAAAGATAAAAAAAACGTATTAATAAAACATTAGAATTAATTAATAACTTTCTATTTGATTTTTTCAAAAATAAA

AATAAAAATAAAAAATAAAATAAGAGTGAGAAAAAATATGTTACTGTTTATTATTATGAAAGTCGATCATATTCAA

ATGTTTGATGTTCAATATATATAAAGTAAACAAAACTGTGTTCTCATTTTTTTAGTCATATTTTTTAAAACTTCTGTTA

AAAAAAGTCATATGTTTTCAATATATATAATAGAATTTATTTTATTTAAAGAGAAGAGCTTCTAAATGAACAAGTGACA

GATATTTATAATTTTAAATAAAGAAACTAGTGAACATGTTTTTTTAAAATATTAATAATTTTATATATAAAAATAAAA

TACCAACCCTTCCTTTCTCGTATACGACATACGGAACTTTTTTATTTTTAATTAAATAAMTATACTATTTGTCTTAGA

ATCCTATTTTTAAAATAAATTTTGTAAAATAAATTTATTAATTGTTTAATTTTATTACAGTTAGTTATTTAATAAGAAA

ATCTATCTCTTAGTTGATTATAAAGGATACAGGGTTTTTTCTGTCCCTAAATTTTTTGTAAAGTTCACTTTTAGTTTCG

AAACAATTTTTTTTTTAGCTTTTTACCCCTTTTATTTTTTTTTATCAACAATTTTAGTCTCAATTATCAAGTATCACCCAT

AACCGATGAAATAACAGTTATGTGTGACTTTCATTGTTATTAATTAGTCTAATGTAATAATTACTTATGAAATTTTATT

TTTTGACAAATTATATTTTTAATCTTTTATCAATTAGTCTAATACCACTAATTATTTTAACAACACACAGGACTAAAA

ATATAATTTATAAAAAAAATTACACATATTTTTCTATATCAAAATCATCAATAAGGTGACAAGTTATGTAACTAACA

ATGTAAATGTCAGGTTGTCAATTTTTTCAACATAAAATTGAATATTATTAAGAGGATATGAAATATATAACCATGTAA

TAGAGACATCATATTATAGACTAGCAAAGACTTACTATCCTACCAAGAATGCAAAATTATACAAAATCTTTAAGACA

TTCCATAGAACAAGAATAGTTGTTGGCAAAAGAAATACCACTAAAATAAACTCCTTACACCTAAACTAGGTCCACTA

AAATGACATTGTGAAAATTGTTCCTCTACAACCATATACACCAGCATGTAGCATACCAAACTATATACCAAAATTGA

CACATTTTCTTTCCCCCCTAAACAACAACCTACGTTGAACATAATGTTGTTGCATCTGATTGTGTTGAGCCTGACAAA

ATGCCAACCATTGATACACACATATCCATACTTGGTAAGAAAAGTGATTTTGGAAGATCAAGTGATTCGTGGTCTCC

ACAAATTGTAAGCACAACACAACTAGTACCATCGTTTGCAACTCCTCTGTGAGGTAAAGCCACCTGAGTTAGCAACC

AATCTCGTAAGAGCCTCCTTAAAAAGACATGTTGGAAGGGACACACACTTCCAAAAATTCTTCGATAGAAATCCTA

GGAAATCTTTGTTTACTATTACATCAAGAGTAAAATAGCATATGCAGTTGCTACTGAGAATTGTTGAGAGCCACCAT

GACTCTATACCCAAGAATCTTGATTGTCCTTGGCCAAGGTAACACCAAACAAAGTTTGCATCAGCTAGTCATTCAAT

TCTTCCTCCCAACAGAACAACCTACATCTCCATTTCCAACAACACTGCCATCCAAATGATGTCCATACACCCATATC

CACCATTACGTTATCTTGTGTAAGATAGATGTGATAAAGATGACGAAAAAAAAAAGCCATTAAACAAGTATCACCTAA

CCATTTATCTTTCCAAAACAAGATCCTTAAGCCATTTCCTACACTTTGAGTAACTAAATTAAGAAACCAACAATCATT

TGTCTAAACTCATAACATCCTTTCCACTCATTAGATGTATTTCTGACTGAATTATTACTACTAGAATTTGAATTCAATC

TCTCATATTTAAAACAAAGCAAATTATACCATATTGCATCTTTATCAGACACAATTTGCCACCTCCATTAAACTAGAA

-continued

GACTGATATTAAACAACTTCAAATTTTTCACTCTAAAACCACTTTTAACTTAGGGAGACTTGCTGCTTCCCAATTAAC

CCAACATATCTTCTTTGTCTCCAAAAAACCACTCCACATACACCATCTTTGTAATTTTATCTACTCATGTTCAAAGTT

CAGACCTCATTTGAGGCACAGAATTTCGTGCTCCTTCTCTCCTTCTCCCTCCACTCATCTTCTTCTACCTTCAAACTCT

TATCCATGGCTTCCTATAGTGATGAGCTTGTTCTTGACTCATCTTCTCCTTAAAGTGACGTCTCCAATCATTTTTCTTC

TTCTCCATTTCGCTACCATTGATCTTAAAGAAACAAAGGACTCCATTGATAGGAAGATCCAAGGCCTACAAGCTCAA

CATGGAGCTACATCGTGTCTTTGGGGCTTTATAACAAGAGAAATAATATAAAGGAAAACATAACAACATCGAATTCA

ACAAAGTAAGCCTCCCCCTAAAGACAAATAACGCCTTTTCCACTGAAACAACTTTTTCTTAAATAAGCTAAAAGTTG

GATCATATGTGGTAGCTCACTCGGGATTTAGCACCAATGACTATTTCCAAGGAATATAAAAGGCAACGTTGCAGTCGA

ACAATGAAGAAATGTTGATGCCATAACCATAAAATTATCATGCTCATTAACACCATATATTTTGCTTTTAAGAGAGTT

TACCTTTTGTACTTGCCAAAAATTGGAGCCAGACTAACATCAGAGTTGTCCGTCGTTAGTGTGGGTACTCTAGTGATC

TTCGTGGTGGTGAATCTGTCAGTATCCTCTGCCTGAGGAATGAGGAGGGAGTAAAAGGTTAAGTTAAAGTGAATATA

GAACCTGATTATTTATAGTGATTGGTGAAAATCCTAGGGTGTTGCCTGAGAGGTTGTTGCAACATCATAACAACCTC

ATTAGTCAGGTGTAACCGCATTGCAACAACTTTGTAACTACCTTGACAGCCAGATACTCGCGTATCGAAATATCATA

ATGACCTAACTACTTAGCCATGTGGCGCTAAGGTTGACCTTCTAGAGAACATCTGTGTTCATGGTCTAGGGCTGACC

AAGATGGAGGGCTAATAAGGACTACTCAATGCTGCATCACTCGCCATGTCACTCGTGAACCCTGGACAGTACACCTT

CAAACCAGAGACAGGCTCAAAGATTCGTGGAATGGCTTTAAGAGCCCACAAGTTGTCCCAATATGCCTCACCAAAC

ATCATCAAATCATTTGTGTATTGTATTAAAGAAAAGGAAATAAAGTCATAAACTTCAAAGCCTTTAACCCCTACCTG

CCTCCACAAATTTACTAACTAAGTCATTCAATCCCTTAACCATTATAAGGGACAAAAAGACACCAAAGAATCACCTT

GTTTAGACCACTTTCATCCAGAAACTCCATTATTAGACTACCATTGACCAAAGTAGACATACAACTTAAGCAAGTTG

CTTTAATCCACTTTCTCCAAGCACTATCAAATCCAAGACAGTCCAACATATAATCAAATAATTTATCATTAACAGAG

TCACGCCATCAATTAATGCTACGACTTAAAAAAGAAAACTAAATTTTTTAACAAAGAATAATATAAAGACAAAAAA

ATGCTAAAATTTTTGTCTAAGGACTAAAACATAATTTAACTATCTAAAAAATTATTCTCATTTAAGAATGTAAGAAAA

TTTATTCTTATTCATAATTTAACATTTAAAATATTTGTATTTTCACACATTAAATATCAACAAATTTTATTCATACAT

TACTATCTAAAAAATGTTAACATATATTTAATATTTAATTAATACTAAACATTATCTAGCCAAAAAAGAAACAAGAT

AAAATAATGAGTAACAATACAACCACAATGATATTGCTAATAATAAAAGCTACAAAAAGAATAATAATAATGATGA

TAAATTAAAAATTAAAAAAAGAGGGAGCAAGTGGGGGAGTTGGCCGAGTCTTGAAGTATAATCATCGTGCATGCAT

TTTGGTGCTGTCTTTCTTCTTTCTTATATTCTGCATGCACACGCCTCCTCTCTCTCTCTTTCTCTCAGTTTCACCCCT

CTCTTCTCTCTCTCTCTCCGGTTACCATCGTCCATTCAAATCTCTCTCCGGTTTCTCTCCGTTCAGATTCCGACAATCT

TCCGATCACACTTCATTATTCCTCTCCACAACGCGCGAATGCGAATCCCAAACCTCACCCCTCGCGGCACCTCCTCC

GCTAAAAATTAACTTCCGGTGACCGGAACTTCCCCTCGTGAACTTCCGGCGACCGGAGGAACCACTCGAGCTTCGC

TCTCCCGCTTAATTTCGGTACGGGCGCTTCTCCGCAGCCGGATTTTACATCCGGCGTCGCGCGAGTCGGTGAGGTGA

CAGTTAGGGTTTTTCGTTCTGATTTTTCTGATTTTTTTTTTTGCAGAGTCTGTGTGGAATTGGAGTTGAAAATGGAGTC

AAGGAGCTGCATGAACGTGGCGTGCGCCACCTCGACGACGATTCGGTGGCGCAAAGGCTGGGCCCTGCGATCCGGC

GAATTCGCCGATCTCTGCGATAAGTGCGGGTAATGATGCTCTAGATTTCGAATCGATGAGCGTGTGTTGAAATTGAC

GCGTGAGTTGATACGTGGATGCACGGAACACAACAGTTGATTAGAACTTGGAGTAATTTTGTGATTTGTTGCTTTG

TTATTGTTAATTATATGCTGTTTTGGGGTTTTTTTTTAATGTTTTTACTTTGAAGTATTTAATTTAGTTATTTCTTAATCTA

AGTTTTGGCTTGTGGATACCTTTTTTTCCTTCCAATTTTCTAAAGTTAGTGTAGTGGCTTTTTTTGCTGATTTTTTTTTT

TTTTTGCTGAATTTCAGTGTAGTGGCGTTACACGCTTTTATGTTTTTTTlTATTATTTATTTTTTAAATTGTGTGGTAA

GTAGTGGAAGACTTGAAGTTGTCGTAGGTAAAATTGGGTCGCCGAATTTTAATTGTGGCTGCTGACCAGAGACCACA

ATTTAAAACGTTGTTTATGACATGTGTTTTTATATGGCATGCGTTTATTTTTTTTTTACACAATTTTATATGGCATGTGT

-continued

TTATAATTTACAGTATTAATTTTCCTTACTTTTTTTTAATAAATGACAAAAAAGAAATACTTGTGATAAAATGGGAAC

AGAGATTAAAAGAAAAGAAAAGAAAAAACATAGTAGTTGTATAGTAACCAGTTTGTCCGATTGTA

BAC43.FASTA.SCREEN.CONTIG1 (SEQ ID NO: 175)

CAAATCCCATCCTCATTAATACTTCACACCACAACTGTTAACAAACACGA

TTAAGCCAAAAAAGACAATAATAAATGAGAAGAAAAAAAATCAACTAAAT

GTAATTAGTTAAAATAAGCCCAAAGATACATGTTCTATCTATACAAGTTT

AGTATCTATACAACTTTTTAGTAACTATTCAACTATTTAACTTATTAATC

AATCCACTACCCTTAACTAAAAAAACATGTAACAAGCAATGTTAATAACA

GGAAAAAGAAGCATTAAAAGTCAAAAGATGAAAGGATGAAATTTGAAAAT

ACTAATGAATATAAAGAGGGGCAAGTTTAGTTATGTAATTTGTAAAGAAA

CAAGCGCTTGATGGTAATAGAAAGTAGTTTTGCTCTGAGAGGTATACAAC

TATAGACTTCCACTACTAAAAAAAGTACTTTTTACGACTGCTGATCTACC

TTGCCCTTTAACGTATTATTCGACCTTATCATTTTCTGATATATTTTATT

TTTGGTCATGTCATGGTCATCAAGCTTCGTGGTTAGCAACGGGTACACGA

AAAGAGAAAGAGAGGAACAAGGCCAAGTTTGGATGAGAACCTGGTTTTTA

CTGGTAAAGGATGATCCTGGTTTTTACTGCATTTTTTATGTTCTGATGTA

TTTGCTTCTAAACTTTGTATGTTGTCTTATGACTTGGCCTAGGTAAATCT

TGTACAGTCTTCTAGCTTTTTTATTAATGATATCTCTTTGCTTAATTGCT

TAGAAAAAAAAAACCCGAGTAATAATTCCTTTTCAAGGAAATTAAACAATG

GATTTTCTCATCTAGTAAATCCCATATATGATTTTGTTCATGATTTGTAG

TTTAACATTTAATTTTTTTTATTGCGTAATGCTTTTCAAAATTTAAAACC

CACTTGTCTTATAATAGTGTTAGTGAGTTGACTAAATTGTCCACATTATT

TTTTCAATTTTTTAAGGGTCTGTTAGTGGAAAGAAATGAAAAAAAAAATT

AAAGTGAGATAAAAATTTAAAACTAAAGTGTAGAAATGTGAATCTCACTT

TGTTGATTTCTACTTTCTTTTATCCTCTTTTTCTCCAAACAACACACCCT

AATTGACTAAAGTTGGTTGTGTTGGCAGAGAAGCCGTTCTTCACAATTTT

TATTTTTTTTAACAAAGTCACAACAAATGAATTAGTTGGTTAACTTCTCA

CAAAGTACACATGCATGTCTTACCTTCTAATTGCCTCTATTACCATTGAA

CAAGCTTATAGAGCTTCATATAATTGATAGAGACAAAAAAAATTATATCA

TTCTATGAAATATATAAATTTACGTGATGTTATGTAAGTTTTTTTTTTTT

AATAATGGATTGTTTTTTTTTAAGGTGACCACATTAACAGAGCTTATCTGG

TTTTTGAAAATTTCTTTTGAAATTTATCTGTGGTCCTGTATATATATTTT

GTTTGCAGTAAGAATTTATCTAAATTATCCATTCAGAGTTGTGTGTGTAG

CAAAAATAGGACTTCTGATAAAAATGTGTTTTCTTCAGGTCATTCTTTTT

GATAATCTTAAAAAATTAGTACATGTATCGTAAGAGGTTATCTCCTATGA

TCTATCACTTCTCGTTCAAATTTGAAAACTTTGTTTTGCATATTTATGCT

GTTGTTTGATGGGTAGGACCCATTGAAGGAGATTATTTTTGGACATGATT

GTGATGATTTCTAGTCTGAGTTGCATATGTTTGGTTGTAGGGAAAAAGGT

-continued

GAGCAAAGGTCCTAAGATACAACGGCTGGTCACTCCCCTGACCCTCCAAA

GAAAGAGGGCAAGGATTGCAGATAAGAAGAGAATTGCCAAAGCAAAATCA

GAGGCAGCAGAGTACCAGAAACTTCTTGCCTCCAAAAAAATAAGCCTAGG

TATATGGAATATACTGATATACTCTGAAGGTGTTTATAACAGTTAACTGG

TTTTTATTACTTAATAGTTCAGGTTTCTATTTTAACTTCTGAGTGTCTAG

TTAAGCATTGCTGCTATAGTAGTGCTATGGAACTGAGGAAGCTTCAACTT

GCACAAAATAATACTTAAAAATTAAATAGTAACAAATTTATTAAATAAAA

TTTGGAGCGTGTTACACGTTCGCTGGACTTGGCTCGATGCATGAAGCCCA

CTGAGCCCAGGAGTGTAATACTATTGTTTAAATCAAACTGACATTTATTA

CTAATTTGCTCTTAAACTATTTATTGTGGCAATCATAGTGTCAGACAGTA

CTTATTGTGCAACCAAAAAAAGTCAGTCCTTGTTGTCTTGGTTATTGCAC

TGCAGCGCTCTGTTCTGAACTGCTCAAGCACTGACCCTAATTATACTACC

AGATCAAAATACTTCATACAGTATAATAATATATTTTGCACGTGTTAGAT

GAACAATATCGAGGGTCTTGCCTGTTTTTTATTTCCTGTGATTGATGCAT

ACAGTACTATTTTCATTTTAATTTTCTACATCTATCTTTCGTAATAGATG

GTTTTTATTTCCTGTGACACGCTAGAAGTCATCTCTACTTGAAATACCAT

AAGACAGTAGCATTTTTTCTTGACAGAGATTCAAATTGTCCAGTGCTTGA

TTGGTATTGCTTCCACTTGGAATACTACTTACAATATTTTTCTTGAAATT

TAGAAGAAAACAAAATGATTACATGATTAAGTTATCATTTTCTTTATATT

ATATGTTTATAACATTTTATTTTTTCATTTTGTACCCAATGTATGATATT

ATAAGTTATCAAATTAGTAATTGCTATTGCCAGGTCATTTTGAGGTCCTT

CCATTCTGACTTTTGTCTATGTTTACAAGAAATTCGTTGGTTAAACTATT

TCTTTGTGCCTTATAGTTCCTATTTTAAATTTTAGTCATTGCACAAGAAA

ATTGTGACTTGTAGTAGCCATATGAGAAAACATTAAGTGGTAGCCTCTAC

ACATGCATAAGAATTTTTTAGTTTATACTGTGATGAGAAATCGCATCCTG

TCATCCATGTCATACAGTACCATACTAATAAGTTCTAGAAAACTCTTAGT

TATACTCAGTTGTTATGACTTGAACCTGAAAATCAATTTTTTGTTGTAAT

CACAGGTTCTTGAATTGAATAATTAAGTATAGTTGGGACATCGTGTTCGA

TTTTTTATTGCTAAAGGAAAGGATCAATATACCTCCAATACAAGGTAATG

TTGAAAATCTCCCCATACTACATCGGTTTTACGATAAACGATGTAAAAAG

CTTTCATTTTCTACATCGATTGATTGATAACCGATGTAGCAACGTTACCA

TATCTAGTCATTCTACATCGGTTGAACTATAACTGATGTAGAAACCTTTC

ATTTTCTACATCGGTTGACTGATAACCGATGTAGAAATCTACCCTTTCAA

CATCGTTTCAGCCTGAGAACCGCTGCAGAAAGTTACCCATTCTACATCGG

TTGTAGCTAGACAACCGATGTAGAAAAGCCGGCCTTCAAAGACGGTCATA

-continued

AAACCGATGTTGTGATTCAACGACCCCGGGTTACCACCACGCGTCATAAC
CGATGTAGAAAGGTCGTTATAACCGATGTACAAGGCCTTTATTTTTAGTA
GTGGTTTGGTGTTGTTACGTTACGCTTTGGTGGTGACAAAAAGCTTGTGA
GCTGCATGTTCTCCCGCCCATATTTGGTTTTTTCAAACTTGGAATGTAGT
TAAAAAATTTTGTGTTTTATTTTTTCTGTTGGTCATAATTAAATTATTTG
TTTTAGTTTTAGGTATTATAAAGTTTGGATGTTATATTTATTTTAGGTAT
TTTAAGTTATTATTCAAATATATGGTATGTTAGTTTGTATGAATTTGGAA
TATATATTGTTTAAATTTTTGTTTTGTTATTTTAAATTATTTTGGGTATT
CTAATAACAAAAAACCTTGTTACTAAAACTTCAAATTAAAACTTTATTCT
AATAAAAAATTAATTACTTCAAATAAATATCATGCCAAAAACTTAAAAAA
CTTGTACGCTTTCAAAGTAGAAATTTTAAAGGCACATCAAACCATCAACT
AAGTTGCTATTATAAATAATTAATCTTAAAACTAATAACTTCAAAATAAG
TAAATATAATTAAAAAAATACTACACTCAAACTTTAGATTAAAAATTTAT
TCTAACAAAAAATTAATTATATGATGCAGAAACTTAAAAAACTTGAACGC
TTTGAAAGTAAAAATTTTAAAGGCAGAACGGAAACCTTTGAAAGTAGACA
TTTTAAAGGCAGAACAAATCATTAAAGAAGTTGTTATTATAAATAATTAA
TCTTAACATTAATAACTTCAAAATAAACAAATCTAATTACAAAAAATACT
CGAAACTCAAATTTTATTCCAAACTCAAAATAATTACTTTAAATAAATAA
AAAAATGCCAAAGAAATTAATAAATAAAAATGATGCCAGTCGAAACTCAA
ATTTTATTCCAGACTCAAAATAATTACTTCAAATAAATAAAAACGATGCC
AGAGAAGAGAAATTACTGATTGAGAGAAACTTTAAAAACACTTAGAACAC
TCAGAAATTTTTAAAGGCACAAAGCATCAGCACGAAAGCATCAACATGAA
GTTGCTACTTAAAGGGCACAACACACCTATTTTGTCAATACCATTGGCGA
TATATGCTCCTTGTTTCGCCAACACTGATTGCAAAACCAACTTAGCCTGA
ACCCTACTGCCCTACTGTTATCCTGTGCCCTTTGCACCTTGCCTGCGCCC
TCTGCACCGAAATCTCCAGTCAAAGTGGCAAAAACTGTGCCAGCTATCTC
GCCAGTGACACTGGCGGAATAGCCACATGTCCAGTGCAGGCGTATTTCGC
CATGCATGCTGACGATATACATGCATGCTGGCGATATACATGCATGCATG
GCTGAATCTACGTAAAAAAGAAACCCCCTTGAAAATAGTTTTAAAACAGA
CCTATTCTGGGAATTAGTTTGTAAAACTAACCCCATTAGGTCAATTTAGC
GATGTTTGGCATGCCATCATTTTCATTGTCCCTAATTCTCACCAATCTCA
TACCCAAAAGATTTTGTCACTTTGTAACAAGGGAGCTGTTACTAAGATTT
AATAAAGGACCAAAAGTTTGAACGATAAACTATACAGTATTTTTAACAAT
TTTAATATACTATTATTATATTTTTATTTAATATTTAAGAATATTTCTAT
AATTTAAACTCATGCATTAAGTATAAATTAATTTTATATTATCATTCACT
CATATATCATCATTAATATGATTTTTAAGATAATTATCATAATTATTATA
GATGATAAAATATTATTGAATGAAGTTTTAAATTGTTTTACAATTTTATT
ATATAACTTATTTTTTCTATTTATCAACAATATATTACTTTTATAGCCTC
ATTTGTTGTCCTATTTCTCACTCCCACATATAAGTTAACTTTGTTTTTTC
TTCCTTGAATCTTTTGTCACATTGTAACAAGTGAAATTGTTAACATTTTT

-continued

AAAAAAGCAAATTGTTTGAATAATAAATTAAATTTCAAACAATTTTAATA
TACTAATATTATATTTTTATTTAATATTTTTAAGTTTTCTTAGTATTTAA
GAATATTTATTAACAAGACCTCTTATAGCTATTTTTTTATGGAATGACTA
TTTTTTTTAGTAATGACTATTTTTTTTTAGTAATGAGAATCTTGCATTTC
TATTAACTCACTATAATAATGATGATGACGATTGAGTTAAGTTCAAGTGA
AGCGATTGTATGCATGAGTGTAAATTAGCTTATTTAGTTGACCAGACTTT
CCTTATAATTCACAAAGGTTGTTACAGAAATTTGAAATTTAATGTATCTA
ATGTAAGTATATTAATGCATTAAAATATATATATATATATATATATATAT
ATATATATATATATATATATATATATATATATATATATATATATTAGATT
TTAATGCATTAATATACTTAGATTAGATACATTAAATTTCAAATTTCTGT
AACAACCTTTGTGAATTATAAGGAAAGTCTGGTCAACTAAATAAGCTAAT
NACACTCAGCATACAATCG

BAC43.FASTA.SCREEN.CONTIG2 (SEQ ID NO: 176)
ATTTAGGTGACACTATAGAATACTCAAGCTTTACAATCGGACAAACTGGT
TACTATACAACTACTATGTTTTTTCTTTTCTTTTCTTTTAATCTCTGTTC
CCATTTTATCACAAGTATTTCTTTTTTGTCATTTATTAAAAAAAAGTAAG
GAAAATTAATACTGTAAATTATAAACACATGCCATATAAAATTGTGTAAA
AAAAAAATAAACGCATGCCATATAAAAACACATGTCATAAACAACGTTTT
AAATTGTGGTCTCTGGTCAGCAGCCACAATTAAAATTCGGCGACCCAATT
TTACCTACGACAACTTCAAGTCTTCCACTACTTACCACACAATTTAAAAA
ATAAATAATAAAAAAAAACATAAAAGCGTGTAAACGCCACTACACTGAAA
TTCAGCAAAAAAAAAAAAAAATCAGCAAAAAAAGCCACTACACTAACTTT
AGAAAATTGGAAGGAAAAAAAGGTATCCACAAGCCAAAACTTAGATTAAG
AAATAACTAAATTAAATACTTCAAAGTAAAAACATTAAAAAAAACCCCAA
AACAGCAAATAATTAACAATAACAAAGCAACAAATCACAAAATTACTCCA
AAGTTCTAATCAACTGTTGTGTTCCGTGCATCCACGTATCAAACTCACGC
GTCAATTTCAACACACGCTCATCGATTCGAAATCTAGAGCATCATTACCC
GCACTTATCGCAGAGATCGGCGAATTCGCCGGATCGCAGGGCCCAGCCTT
TGCGCCACCGAATCGTCGTCGAGGTGGCGCACGCCACGTTCATGCAGCTC
CTTGACTCCATTTTCAACTCCAATTCCACACAGACTCTGCAAAAAAAAAA
ATCAGAAAAATCAGAACGAAAAACCCTAACTGTCACCTCACCGACTCGCG
CGACGCCGGATGTAAAATCCGGCTGCGGAGAAGCGCCCGTACCGAAATTA
AGCGGGAGAGCGAAGCTCGAGTGGTTCCTCCGGTCGCCGGAAGTTCACGA
GGGGAAGTTCCGGTCACCGGAAGTTAATTTTTAAGCGGAGGAGGTGCCGC
GAGGGGTGAGGTTTGGGATTCGCATTCGCGCGTTGTGGAGAGGAATAATG
AAGTGTGATCGGAAGATTGTCGGAATCTGAACGGAGAGAAACCGGAGAGA
GATTTGAATGGACGATGGTAACCGGAGAGAGAGAGAGAAGAGAGGGGTGA
AACTGAGAGAAAGAGAGAGAGAGAGGAGGCGTGTGCATGCAGAATATAAG
AAAGAAGAAAGACAGCACCAAAATGCATGCACGATGATTATACTTCAAGA

-continued

CTCGGCCAACTCCCCCACTTGCTCCCTCTTTTTTTAATTTTTAATTTATC

ATCATTATTATTATTCTTTTTGTAGCTTTTATTATTAGCAATATCATTGT

GGTTGTATTGTTACTCATTATTTTATCTTGTTTCTTTTTTGGCTAGATAA

TGTTTAGTATTAATTAAATATTAAATATATGTTAACATTTTTTAGATAGT

AATGTATGAATAAAATTTGTTGATATTTAATGTGTGAAAATACAAATATT

TTAAATGTTAAATTATGAATAAGAATAAAATTTTCTTACATTCTTAAATG

AGAATAATTTTTTAGATAGTTAAATTATGTTTTAGTCCTTAGACAAAAAT

TTTAGCATTTTTTTGTCTTTATATTATTCTTTGTTAAAAAATTTAGTTTT

CTTTTTTAAGTCGTAGCATTAATTGATGGCGTGACTCTGTTAATGATAAA

TTATTTGATTATATGTTGGACTGTCTTGGATTTGATAGTGCTTGGAGAAA

GTGGATTAAAGCAACTTGCTTAAGTTGTATGTCTACTTTGGTCAATGGTA

GTCTAATAATGGAGTTTCTGGATGAAAGTGGTCTAAACAAGGTGATTCTT

TGGTGTCTTTTTGTCCCTTATAATGGTTAAGGGATTGAATGACTTAGTTA

GTAAATTTGTGGAGGCAGGTAGGGGTTAAAGGCTTTGAAGTTTATGACTT

TATTTCCTTTTCTTTAATACAATACACAAATGATTTGATGATGTTTGGTG

AGGCATATTGGGACAACTTGTGGGCTCTTAAAGCCATTCCACGAATCTTT

GAGCCTGTCTCTGGTTTGAAGGTGTACTGTCCAGGGTTCACGAGTGACAT

GGCGAGTGATGCAGCATTGAGTAGTCCTTATTAGCCCTCCATCTTGGTCA

GCCCTAGACCATGAACACAGATGTTCTCTAGAAGGTCAACCTTAGCGCCA

CATGGCTAAGTAGTTAGGTCATTATGATATTTCGATACGCGAGTATCTGG

CTGTCAAGGTAGTTACAAAGTTGTTGCAATGCGGTTACACCTGACTAATG

AGGTTGTTATGATGTTGCAACAACCTCTCAGGCAACACCCTAGGATTTTC

ACCAATCACTATAAATAATCAGGTTCTATATTCACTTTAACTTAACCTTT

TACTCCCTCCTCATTCCTCAGGCAGAGGATACTGACAGATTCACCACCAC

GAAGATCACTAGAGTACCCACACTAACGAGGGACAACTCTGATGTTAGTC

TGGCTCCAATTTTTGGCAAGTACAAAAGGTAAACTCTCTTAAAAGCAAAA

TATATGGTGTTAATGAGCATGATAATTTTATGGTTATGGCATCAACATTT

CTTCATTGTTCGACTGCAACGTTGCCTTTTATATTCCTTGGAATAGTCAT

TGGTGCTAATCCCGAGTGAGCTACCACATATGATCCAACTTTTAGCTTAT

TTAAGAAAAAGTTGTTTCAGTGGAAAAGGCGTTATTTGTCTTTAGGGGGA

GGCTTACTTTGTTGAATTCGATGTTGTTATGTTTTCCTTTATATTATTTC

TCTTGTTATAAAGCCCCAAAGACACGATGTAGCTCCATGTTGAGCTTGTA

GGCCTTGGATCTTCCTATCAATGGAGTCCTTTGTTTCTTTAAGATCAATG

GTAGCGAAATGGAGAAGAAGAAAAATGATTGGAGACGTCACTTTAAGGAG

AAGATGAGTCAAGAACAAGCTCATCACTATAGGAAGCCATGGATAAGAGT

TTGAAGGTAGAAGAAGATGAGTGGAGGGAGAAGGAGAGAAGGAGCACGAA

ATTCTGTGCCTCAAATGAGGTCTGAACTTTGAACATGAGTAGATAAAATT

ACAAAGATGGTGTATGTGGAGTGGTTTTTTGGAGACAAAGAAGATATGTT

GGGTTAATTGGGAAGCAGCAAGTGTCCCTAAGTTAAAAGTGGTTTTAGAG

TGAAAAATTTGAAGTTGTTTAATATCAGTCTTCTAGTTTAATGGAGGTGG

-continued

CAAATTGTGTCTGATAAAGATGCAATATGGTATAATTTGCTTTGTTTTAA

ATATGAGAGATTGAATTCAAATTCTAGTAGTAATAATTCAGTCAGAAATA

CATCTAATGAGTGGAAGGATGTTATGAGTTTAGACAAATGATTGTTGGTT

TCTTAATTTAGTTACTCAAAGTGTAGGAAATGGCTTAAGGATCTTGTTTT

GGAAAGATAAATGGTTAGGTGATACTTGTTTAATGGCTTTTTTTTTCGTC

ATCTTTATCACATCTATCTTACACAAGATAACGTAATGGTGGATATGGGT

GTATGGACATCATTTGGATGGCAGTGTTGTTGGAAATGGAGATGTAGGTT

GTTCTGTTGGGAGGAAGAATTGAATGACTAGCTGATGCAAACTTTGTTTG

GTGTTACCTTGGCCAAGGACAATCAAGATTCTTGGGTATAGAGTCATGGT

GGCTCTCAACAATTCTCAGTAGCAACTGCATATGCTATTTTACTCTTGAT

GTAATAGTAAACAAAGATTTCCTAGGATTTCTATCGAAGAATTTTTGGAA

GTGTGTGTCCCTTTCCAACATGTCTTTTTAAGGAGGCTCTTACGAGATTG

GTTGCTAACTCAGGTGGCTTTACCTCACAGAGGAGTTGCAAACGATGGTA

CTAGTTGTGTTGTGCTTACAATTTGTGGAGACCACGAATCACTTGATCTT

CCAAAATCACTTTTCTTACCAAGTATGGATATGTGTGTATCAATGGTTGG

CATTTTGTCAGGCTCAACACAATCAGATGCAACAACATTATGTTCAACGT

AGGTTCTTCTTTAGGGGGGAAAGAAAATGTGTCAATTTTGGTATATAGTT

TGGTATGCTACATGCTGGTGTATATGGTTGTAGAGGAACAATTTTCACAA

TGTCATTTTAGTGGACCTAGTTTAGGTGTAAGGAGTTTATTTTAGTGGTA

TTTCTTTTGCCAACAACTATTCTTGTTCTATGGAATGTCTTAAAGATTTT

GTATAATTTTGCATTCTTGGTAGGATAGTAAGTCTTTGCTAGTCTATAAT

ATGATGTCTCTATTACATGGTTATATATTTCATATCCTCTTAATAATATT

CAATTTTATGTTGAAAAAATTGACAACCTGACATTTACATTGTTAGTTAC

ATAACTTGTCACCTTATTGATGATTTTGATATAGAAAAATATGTGTAATT

TTTTTTATAAATTATATTTTTAGTCCTGTGTGTTGTTAAAATAATTAGTG

GTATTAGACTAATTGATAAAAGATTAAAAATATAATTTGTCAAAAAATAA

AATTTCATAAGTAATTATTACATTAGACTAATTAATAACAATGAAAGTCA

CACATAACTGTTATTTCATCGGTTATGGGTGATACTTGATAATTGAGACT

AAAATTGTTGATAAAAAAAATAAAAGGGGTAAAAAGCTAAAAAAAAAATT

GTTTCGAAACTAAAAGTGAACTTTACAAAAAATTTAGGGACAGAAAAAAC

CCTGTATCCTTTATAATCAACTAAGAGATAGATTTTCTTATTAAATAACT

AACTGTAATAAAATTAAACAATTAATAAATTTATTTTACAAAATTTATTT

TAAAAATAGGATTCTAAGACAAATAGTATAATTTATTTAATTAAAAATAA

AAAAGTTCCGTATGTCGTATACGAGAAAGGAAGGGTTGGTATTTTATTTT

TATATATAAAATTATTAATATTTTAAAAAAACATGTTCACTAGTTTCTTT

ATTTAAAATTATAAATATCTGTCACTTGTTCATTTCAAGCTCTTCTCTTT

AAATAAAATAAATTCTATTATATATATTGAAACATATGACTTTTTTTAAC

AGAAGTTTTAAAAAATATGACTTAAAAAATGAGAACACAGTTTTGTTTAC

TTTATATATATTGAACATCAAACATTTGAATATGATCGACTTTCATAATA

ATAAACAGTAACATATTTTTTCTCACTCTTTATTTTATTTTTTATTTTTA

-continued

```
TTTTTATTTTTGAAAAAATCAAATAGAAAGTTATTAATTAATTCTAATGT
TTTATTAATACGTTTTTTTTATCTTTATATACTTTTTTAATTTTTAAACT
GTATTTAAGTAATAAAAGAATTTCTTGACATGATAAAAGCTTGATTTTTT
TCTTGATGATACTATTCACATGACCTTTTTATAAACAATATATAATAAAC
AAATAATTAATATATTTCCTTATCTTTTGAATGCTATTTATTTTATAAAA
TAAAATCTTTAGTATTTATTTTTAAATTTTTTAAATATTAATAAAATGTG
AAAAATACCTATAAATTATACACGAGTTAAAATATTAATTATCAAAAGCA
TTAAAGTAATTTTCTCATTCTCTATCGTATCACTTTATAGTAGTATTTTT
TTTTCTTTCAAATTTCTTCTTTTTAATGTTTTCATGCACCCTATTTTGGT
ATTTTAGGTTGAACGTTATCAGTACCCATATTAAAAAATTCATCAAAAAA
AGTACCCAAATTAAAATATCCAAAAGAACAGATAAATACGCAGAAATATA
GCGTATAATGGAAAATGCGACCGCTAGCACCGGAAAATGCGCCACTTAGA
TACAGTTATTTTGATGAATTTACTATAGTATCCTTTGTTAGCCACAACGT
AGGAGCACGTATTCACCCGTCAAGAGGTTTGCCCTTTTTCGTCCAATTTC
GATTTCTATGTGGACCCAATTAAATATTGGTCAACCTTCCGAACATTGAA
GTATAAATAATATTCATCTTTATCTTTTATCTGTATCCGTACTATATCTA
TATTTATATTACACTGTAAACACAGATAACAAGAATATTACAATATATGC
TAGTAAAATCATGTAGTTATAATACTTTTCCTCCAAAATCTATGCTTTTT
ACATAAGTTGTGTAATAAAACATTTAATTATTTTTTTTACAGGTTGTACT
TGTGAAACTAAAATGAAAAGTAAAAATCCTTGTTATAAATAATTTAATTT
ATACATGTGATAAAATAAAATGATTTTTATTTAATAATAAATCAGCTACT
AACTTTTTTTGTATAAAATTAATTCAAACATATGTTATGTTAATCAATAA
ATATATTTTTTTAGTTTTTTTATATTTCGATAATAAATTTCTAATTGTAT
GATTATCACATACATAATAATACGCCAATTTTTTTATACGTGTAATAATA
TACATGATAAGTTTAATGAATGCTCATTATTGTAAAATATTTTGATAGAA
ATATTCAATAGGGTTTAATTATTTTATCACATCAATTTTGTAGAGGAAAT
TTATCCCATCATCATCTTAATAATTATTATAATCTAGCGATAAAATGATT
TTGTACAAAACATATAAAAATATTTTACAATAAGTGAGTGTACAAGTTAC
TAAACAAGTGTGTCTACATATTAAACTCCAATAACAAAGCAATTAAAATT
TAATATTTAGATAATAATACGGAAAAACATTTTACATTAAGTGCGTCTAC
AAATTAAACACAAATAACATAGCAATGAAAAAAATAATATTTACATAATA
GTAGTAATTCGGAAAAACATTTTTATATTAGTATTAAAAGCTTTGACAGT
TATAACTGTTACTTAAACCTTAAAAGCTTCAACTAATATTTTCTTTTAAC
AGAGTTTCAACTAATGTGTTTGGTTGGAAAACTTAATTACTAGTATTATG
GTTTTTTTTTAGTTGGAAGCACGTTTTTCAGTTGAGTAAGTAGAAGTTAT
TATGACGTGAGTGTGTTGTGTGATGACGAGGGTGACGCAAAAGTAAAGGA
ATCACGTCGAGTCGACAGGTAAAAGACAATGACAGAGCCATCTCCATCTG
AGTTAGTGCCAATCGCACGCGTGATTGCTGTGCCTGGATTTAAAATATAA
AATACATTTAAATCTATCTTTTATTATTTAAATATTTTTATGTTTAAATA
TTTGTACATTATCTTATGATATATTTATTTATCAAAATAAATTTGCAAAC
```

-continued

```
TAGTATGTTAATTTTTGTTGTATCTTATTTTAAGTTAACATAAATTTTTT
AACTTAAGATAAATTTAAAAATACACAGAGATAGTATTCGAATACAGTTT
ACTATTTGCGCATGACCTAACATTACGTATGGATTATGTAATACGCAACC
AAAAATATCTCGCGGATTTATCGGTTGATCTTTGTTCAAATTGGCGATGG
CCGAAAGTGTTATCTTCAACATCCTTATAATGATTATGATAATCAAAAGA
CATTTTATTTTGTTATAATTCATTAATGATAGACATTAAATATGATTTAA
ATTTAATTCTAAATCTTTATATATATATATATATATATATATATATATAT
ATATATATATATTATTTTTTTAGTTGTGATTCAGTTTTAATATTTTATTA
TCAATAACCATGAAATAATGTTATAGAAGATGATATATTTATTCACAGTT
TCATATTAATAAAAATTATATTTCTATTTTCTTAACATATTTATCTTGTT
GATACTATTTAATTTCTATTGATCGTCAATAAATTTATTTATTTTTCTTT
CTCGCATGATTGTGTTATTTGTGACCTTAAAGCATAATATGGAGATAGAA
TTAATCAACATAAGTCATTTGATAATATAAGTTAAGTTTATGGATTAGAA
TTTGAGTTTGATTTTTGTAAAATACATTCTTTTTGAAAAAAATAATAATT
TTTAAGTATAATTAAGTCTCACTTCTAATTGAAAATTAATCTTATAATTA
ATTCAAATAATCAAAGTTTATGAACATACATTAGAATATTATTGGGAACC
TAAGATCCTAATTGCATATGGTGATACTAAATAAAAAAAATGTACATACT
TCTTAAATTCAACGCTGATACATTAAAAAAAATCAACACTAGATAAAATT
TTGAGTAAGACTTTTTCTACCAGGAGACATATGATTTTTATTAAGTTTTT
ATGTGTAAAAATTTGACTTAATTATACTTATTTTCTCATGTATCATTATA
ATATAATTTTATTCTCTAATTAATTGAGTCTCCTGAATATTATAAGTGTG
AGATTTTAATCCTTTTGATAGTTGGCGGCATTGATTGATATGGTATTGGC
ATTAAACTGAGATAGTGATTAATTTGGCATCTTATTTGATTTTTAATTTG
ACTTGTTTGATTTTAGTCCTTGGGAGTTTTATAATCATGTCATTTTAGTT
TTTTTGTATTGCATAATGATAGAATTTTAGTTTTTTAAAGTGATGTAGAC
TAAAATGATGAAAACATTCATAAAATGTTATAGTTTGATTCAATCCCATG
TCACACATTAATAGTGTTTATTAAACCACTATACCTATAACATTTTTTTA
TTATAGGTATACCTAAGCCTAAATAACTAAAATTATAATATATAAGTTAA
ATACAATAATATTAATAATATCATTTTTATAGGTGACTTTAAGCAATTAA
TTATACTATTCATTCGTTAACTATTTTCTTAATTAATTATTTTATAATAT
TTAAATACATATTTTCCACTTTACTAATAACACTGTTTAGTTTTTTTTTA
ATACGGCTTTGTACTCTCATATGCTATTGAATCGGGAAAAACACAATACA
AATTAAGTTAATTTATGCAAAACAATTTTTTTACGAGATTATGTAGGAAA
TATTATAAAATTTCTATGAATATTTTGATGAGCTTAAGAAAATTAACAAA
ACCAATGTTAATTAATTAATTTCTACCAGGAAAAAAAAAAAGGCAGAAGCC
AATGAAATTTAAGGGGTACAGCAAAGATTTGTAGAACCATCATTAATATT
AGTGCAACATACCATGATGAAGTGCATGACATAATAATAATGTGGAGCCA
ATTGTGATAAGAACAGAAAATAAATTAGTGTAATTGCATGATCAGAATAA
AGAGAAGATATATCATGTTCATATTGATCAGAAAATAAGGCAACATGTTA
AAGAAATGTGCCAGGTGCAACAATGAGGGAACAAAAAAGAGAAGGATAAT
```

-continued

AAAGAATGTGGTTATGACTTTTACAAAATCGAATTATTTACTTTTTTAAT

TTTTTATATTTTCCTTTTTACTTTCCTAATAGTTGTCCGATTAAGAGGAA

TTTATGGAGTAGATTAGATTGATTTTGAAAAAGAGAAATATCATCTTATA

CAATTTTTGGTTTTTTTAATTCATTGTTCAATTGATGTAGTTTAAAATTT

AAATATGATTTAATCAGTCTAGATTGATCTCAATTTTAAGTTTTAATTTT

ATTTCTATTTTTTTAAAAAATAAATATTTAACATATATAATAATTGTGAT

ACAAAGTAATTTAAAATATTTCTCCAAAAAATGTAATTTAAAATATCACA

TATATATAAATCATTTTCCCGCTAATAGTAATATTTCTATAAAAAAAGCT

AAAAGTATATCTCTGTTATATAAGTTGATAATTATATTTATATATACTTG

AATAGTTACTGAATATTATAATTAATTAAATTTACTTTTCATAAATAATT

TTAAGCAATGTAATATATATATATATATATATATATATATATATATATAT

GCTTGTCCCTGCTATATGTTGATTTTTTTTTTAGAAAACAATGTTTTTG

ACGAGTGAGATGCGATATATCTATTATTGATGAATATCATTATTGTCTTG

ATTAGACTTGTGTTGTTTGAAATCCTAGAGAATGTGAATCTCAGACATGA

AAGATATATGTATATGCATAATGCGACTTATTGTTGATGTTGTTATTGAT

GAATTTAATTGATATGTGGTGATGTTGACATTTATGATGATATTGATTTG

AGATGACGTTGTTAATGATGATCATGTCAACATGAATTGATGTTATTATT

GATGATTATGTTAATATGAAATGATGTGGTTGTTGTTGATAATGTCATTG

AGATGATGAGATGTTGATGTTGAGAGTGATATTGAAATGAGATGTTGATG

ATGTTGGAAATGCGTTGAGATGAAGCATGTTGTGTATGTTCGTGATGGGG

TGCATTGACCTTGTCGGATGTCCCTGGTAGGGGAAAATAAAGTGGTTAAA

GAGTTTAAGCATCTCTGAGGGGATGACTTAGGATCTTTAATTCATTCATG

GTCAGTGTACTTGATGGTGCCCACATTTTATACGTTGTATGTTGTGTATG

TTCATGGGGGTGCATTGACTTTGTCGGATGTCCTTGGTGGGGGAAAATAG

AGTGGTTAAAGAGTTGCATGTGTACGACAGGATGACCTCGACACTTATTG

TCTTGTTTTTCTAAGTGAGAGTGTCGTGTGGACACGCTTATGCTATTTCC

TTGGGGATGGTACCACATTGCATCTAAGAGTTGAGATCAGGTGCATGCAT

CATACTGAACATGATTAATTGGAACTATGTATGAATGATGACTATTTGTT

GAGTGTGTGTTGATTAATGAATGTTGTATAAGCTCATGATATTTGTTAAT

GTTTTCTTGCTAATTGTGGTTATTTGAATTTAGTATTAGTTCTTTTTATA

ATGAACTCACCCTTGCAATTTGTATCGTGTGGTTGATACTTGTGATGATC

GCGAACCTTGTTCGTGGGAGCAGAATGACAGCAGTAAGGTGCAGAAAGTG

AGATTCTGATGTGAAGTCGCCGAACTGACGTGATGACGTTGAGATTATTT

TGAGAGAGAGTTGTGTTTTGTTAATCAACTCCTTCATAGTTGGTTCCATA

ATTTTTTTGTTGAATTAAGGATGTAAATCACAAACTTAATTATATGTATG

AACAAATTTACCTTCCATTGTGTGAATGATGTGTACTAAGTTACTATGCC

TATATATATGTATGTATTCATTTAAGTAATGATGCGTTGTTTCGGAATGT

ATATCGTGAAATTAAAATTACTTTAATTTTTCATAAGCAAATTAATGGAG

TTTTTCATTTAAAAATTGAAATTTTTCGCAGTTTAGAGTGGTGATATCGT

AACGAAGAGGCGGGCCATTACAATGAGTGACCATACTATTAGAATGAAAA

-continued

TAAGAAAATTAAAAAGTTGAGTTAGAAATTTTATTATATTTTATTTTCAA

AGTTAATATGTAATATATATTCTTGTGACCAACATGTTATTGCTTAGAGT

GAAACTAAATCTGTTGCAACCAAGTGACTAAGTGACTGAGTACAAGTGGT

TAGTGTATTTAAAATAAAGTTGAATCGTTTGAATATTACCTGAGTTCGGC

TTAACAGAAATAATTATTGGTAAGACTTTACTTAGCTTGTGACTTTAGCA

TCATTTCCCATGATGAACTGAAAAGTTAAGACAAATCCCCTTGAGCCAAG

ATTTTAGATTTAAGTCTTACATATTAAAAATAATTGAAAATAGTGACTTC

GTTAAAGATGAATAACTAAATTTCTCTATGAAGATGAGTTATCAGTATAT

AAAATTAATAAATACTTTGTATTAATGTCATGGAAACAAATATAATTTAT

ACTTAGTGCATGAGTTTAAATTATAGAAATATTCTTAAATATTAAATAAA

AATATAATAATAGTATATTAAAATTGTTAGAAAATACATTATAATTTATC

TTTTACAGCAGATAAAAATAATTGTGAGGAGAAAAAATAAATTAGAGGAT

AAATATTTATAAAACTTTAACAAACTAATAAAAAAAGTTTTCATTTTTAG

AGTTATGTCTATTTATATTACATGTAAAGAAAATTTAAATTTTTATGAGT

AGTTGGATCTAGGACTTTAACTACACAATAATCATTGATACCAAGTTCAC

TTAAATTTATCTCAACAATTGATAAAAACTTATATTTCATAATAATTGTT

GATTTAAAATAAAAAAAAATATTTTATAGAAATTATATTTATTAAATATC

ATAAGAGAAAAATATATCTTTTTTTAAATATAATAAAATATTTTCATTTG

CTCATCATTTCTTTGTTGACTTAAATTTTCTTTCTCTCTCATTTTACTAT

TGTTGTTTGAGATAATCTCATTATTTTTTTTTACTTAACTAACAGTAATA

TTTTTGTATAGATAAGATTTGAAGGATGAAATTTCATAAAAATATAAATC

AAACAATTACAATAAATATGTAACATATAAAAGTAGAGTTGAATTAAATG

ATGATTTTTTATGCCACAATTTTAAAAGAATTACTTTTATTCCTCCCTCT

AGATACCGAAAACACCAATTTACTTAAGTAGAGTAAGGACAAGACCAGAT

ATTTCTGAACTTTTTATCACATTCCCAACCTGAAAAAAACATGAAATAAA

AAACATTAATCACAGAAGCAGGAATCAAATGGATAGAATAGTTTGTAAGT

CAAGACTAACGTGTTGAAGGGGCCATTTGCCCAGCTGACTGACTATAGGA

TGTGTATCAGTCAAAACCTTCAAATACCGAGATGGGTTAAGGTAATGCAA

TCTATAGCTTAAAAGGAATTTAGAAGTGAAAAATAATGTTTGCTTCATAT

TATATCTCAGTCAATTTGGGAACAATCTTAAGGAGACACCGAGACAAATG

TTGAGGAGCACGGTATGCCATAGCACCAAGTACTTGTACACTACTTTGTT

TTGTCCTCCAAGCTTTAACTTCAAGACCCCGAACAAATAGATTAGCTATG

CGATAGTTCATCGAAATAGATGTTATGGATAGTAATTTTTTTAATTTGTT

CAATTTACATGCTATGTTGGAATGAAATTAATTGAAAAGAAGCATTGGGC

TGTAAACAAGGTTGCATTTCGGTTTGCAGTATATTTGTTTGTACTGACCC

ATGATGTTATGATTGCTCTTTCATCTTGCTTAGCAGTAAACGATACATAA

TATTGCATGACTTAAAAAGAAAGGCACAAATAAGGAGATTTGATGTTTGC

TTGCAGAATGCACATTGATTTATGCTTGAAGGCTGACACCTTGCCATTTT

ATCTCCTTTATTGTATTTTAACATGATGTTTTAATGTTTATTGAAGCTCA

TCATATTGGACGTGCCACTGGTAGTGGGCTAGTGACAAGGTCTTTGGGTA

-continued

GTTTGCAGGTGATACTAGGTTCAAACATTTGTGCAATCATTTTTAAGTAA
TTGCATTTCATTTGGACTAAAACTGGTATAGTTTATTGGATTGACTTTTC
AAAAACACCATGTCAATGTGTGCAACATAATTAAATTAATATAGATGTAA
ATAAAATCTCAATAATTAGTCAATTACATCAATAAAATAAATAATGTCTT
AACAAAAGAAAATCCAAACAATAAATCTAAAATATGAAATTTAAACATCT
CTAACAATAAATGATTCCATATTTGAAGTAGCTTGAACATTCTCCATCTC
CACATTTAAGAGTACAACAAAAATGAATCAGTCCCAACAAAAATAGGATA
AAAACAAATTCTAGAGAGAGAAGAGATGTACTTTGCGTGGTGGCACGGTG
GTGGGCCGAAGCTGTGTCGCTGTGGTGTGTCGCGTGACTGCGTGAATATG
AGTCGCGTTTTGTTTTCCTTGTAAGGGAAAGAGTGTTAAATATGATGTGA
ACTATTTTTTATAATAAAAATATATTGAAATATCTTTAAAAATATTTATT
TAACAATTATTTTTAGCTTAAATGATAAGAATTGATATTTTTATTATTTA
TGACTTGCAAATATGAAAATGATAGATTAAAAGAAAAAAAGATCGAGAAA
ATATCAAAAAGGAAGATTTTTAGCATGTTATCACTTATATTTTTTTATCT
TAATCTTTTATTTCTGTTATCTTTTATTTTTCTTATCTTATCTTTTTTAT
CTTTACCATCTTTTAATTTAAATCTTTTATTTTTACCTTTAAATCTTTTA
TTTTTACCTTTAAATCTTTATCTTATATAATATATTTCTTCATTTGTTAT
TTTAAAAGAAAAGTTTAAAGTGAAAAAGAGAAAATCAAACCTAATATAAT
TGGGTCAGGGTCACACAAATCAAACCAAATGCGGGTTGCGGGCAACCCGT
GGACCCCGCGGCCAAACCCGCATAGTCCGCGGGTTAAGCGGGGCGGACCA
AAAAATATGACATAACCATGAACTGTTTTAAAAAATTGGTTCGTAACTCG
AGCGGATCGCGGGCGCCACGGGCCAGTCCATGGACCTGGGCCCATTTACC
CACCCCTAGTCTACAGGTTCCTGATCCTTTGCGATTAAGAGATGAACCCT
AGAGGCACATCAATGGCCTCTATGGAACTTCTCATCGAATGTGAAGCATA
GCCCGTGCTTATGGCGCGAGGCTAACTCCTCCGGGGTGAGACGCCTGACG
GTCGGAGCCTATGGCGGGGAAGGCAGCAAAGGGGGCAAAGGCGTGATACG
AGGGGGAACCAAAGGGGCTGGTGGTGGAGCTACCAACGGTGGGGTCGCGG
CCGCGGTGGAGGCAGACGAAGGTCCGATAGCTTCTGCTCCTGGATCTTCG
CAAGGCTGGCGGCCTGGTCCACAGTCATAGGCTGGTGGACCTGGACTGTG
CGGCGGATCTCCGACGTCAAACCCGAGATGAAGCAAGGCAACAGGAAGGG
GGCCGACAAGCCGATAATTCTATTAGCCAAGTCTTCGAACTCCTTCAGGT
ATGTTAGCACTGAACCCGTCTGAGTGAGTTTGAACAAGGCATCGACAGGA
TCCTCATACGGTGATGAGGCATATCGGATTTGTGCAGGAACAGAGGTGGA
GTGGCAAGGGACTGGTGTGGGGTTGGGCGTGGTGGAGGAAGGCACAGGAG
CAAGGCGGTTGCGAAGCTTGTCCATATTGAGGGTCATAGAGTGCATGGTA
TTGTCAAGACGAACAAGGGCCTTGTCGAGGTTGCGTGAGGCCATGAGGAC
AAACGAGAGCACCAATTGTTACGAACTGAACATAAATGCAGGAAATTAAG
AGCTGGCTTCGAGGCACCAGAACCTCCAGAGGAAGAAGAAGAGCAGAGAT
GAGAGTAATTTGCTAATTTCATTCATATCGTGCTGCTTATTACATGCTAT
TGTATTTATACTGATTTCTACATAACAGATTTTGTCCTTTTGTGCTAGAG

-continued

GAAATCAGAAATCGTTATTCTTGTCTCCCTTGCTTCTAGCACAGATCATT
CAGCATCATTCCTTAGGATCACACGTAGTCCTTAAGGTAAGCAGGCTTCG
AGATCTTTCTTTTGGTATTAACTGCTGCTTGCACCTCCTTTTCTACTTGA
TTTACACCCTTCTTTGCTATAGACACCCCTGTAGTTGCTATGTCTTGATT
CACATCTATTTTTTCTGAATACATCCCTTTGTATGCTATGCTATCACTCT
TCCCTATCAGAGGGGGTCTCTGGTTTTGTTTTTCCTAATTACCATTATGT
AAGATCTAGCTTGTATCCGCCTTCTTCTTCTTCTTCTTATTACAACTTTT
TCACAATATTCTTTACTATATTAGCATCTAGGCCAACCTGATAAGTCACG
CACCACCATAATAATAATATTTAACTTTTTTTTATTTTTTAAAGAAAAAT
TAATTCCTTTATTTTTTTAAATATTATTTTTATATTAAAATATATTTAGT
AAAACAGTAATATTAAAAAATTAATTTATTTTTAATGTAAAAATAATATT
TAAAAAAATAAAGGAATTAATTTTTCTTTTTTTAAAAAATAAATTTTTAT
TTAACAAGTTAAATTAATAAATGAATTTTTTGTTTATAGTATTTTTTTAA
AAATGTATAAAAACTAATTATATATATATATTTTTAACAATTTATTTATACT
GGAATACATTACATCATAAATAAAATACATGAACAATAATATTTATCTAA
GAAAAAACTGAAGATGAAGATATATTGAAATAATTTTTTCTGTTATGTTT
TTATTATCGAAAATTTTCACATTTTTTTTTCTAGAATGAATACCATAGTT
GTTAGGTAAAAAAACTATGGTAGGTTGTAACATGTCTCCTTCCCAAGGAT
TAATAATCAAATGAGGTTGATAATGGGAATGATTCATGTGTTAGTTGTTT
ATGCTTTCATTATTTTCATGTTTCAATTATTATTGTTAGTCCATTCTGTT
ATTTTTGCTTTATTATATGTTCCATTTATGATGTTTGTCTCTTTAATTTT
TAATATTTTATGTTATTTGAGTATTTTAATTTCTTAATATAATATAATTA
AGATGTGATAATCATATATTTATTGGGTTTTTAATCAATCTATTTTTTTA
ATCACTTTGTTTTTTAAATTTATTTTAAGATTATTAATTAATTATTTTCA
AACTATAAATAAATAATTAAACAAAAAATATTCTCATTATTTAAAAAACA
AAATAATAATAATAAAAAATTTAGTTATTTTTTTATCTGAAAATAATATT
TAAAAAACAAGTAAATTATTTTTAAAAAAATATAAAAAAAGAATTTAATA
ATTTTTTTTAAATTAAAAAATAATAGGAGCAAAGAGAAGTTGGGTTCCCT
AACCCCGACTTCTCTCTGCAAGCTAAAAAGGAGTGTTGTTTAGGAAACAA
TTTTGAGGCAGGTGTATTTTGGAAAAAATGAGGAGAGAGCAAGTGTAGTG
GAGTAAAAAAATCCTGTAAGGTTTTGTTTGGTAGTAAAAGAAAAAAATA
ATTGTAATGAGAAAAAATAAGTTAGAGGATAAATATCTTCAACACTTAAA
CAAACAAATAAAAAAGTTTTTCTAGGAAGTTCACTTAAATCTATTTTAAC
TATTGATAAAAAATTTATACCTGTTGATTTAAAATAAAATTATATTTATTA
AATATGATAGGAGAAAAAATATTTTTTACATATAGTAAAATATTTTCATT
TGCTGAACTTAAATTTTCTTTATCTCTCATTTTACTATTGTTGTTTGAGA
TGATCTCACTGAATATATTAATAATAAAATTTTTATATAAATAAGATTCA
AAGGATAATCACCAACCAAGAAATTTTATGGAAGTATTTATCAAATAATT
ACAATAGATATATAACATAAAAAAAAGAGTTGAATTGAATAATAATTTTT
CATGCCATCATTTCAAAAGAATTACTTTAATCACTCTCTTTATATTATTA

-continued

TTATTATTATTATAACATCTTCACAATATTTTTATTTTATTAGTATTTA

TTGATTTTATTTAATAAAAAATCACACACTTTTCTTTTTGCACACATCTT

TAATCTACATATAAGGATATTCAAATCTTGACTTCATTAATATATATTAT

TGTTTTTAGGGATCAATTAGCATGTGTCTTTTCTTTAATTCTTTCTCTTT

TAATTTGTTCAACATTTTTATTGTGTTAATAATTTTTTAATCTCATTTTT

TTATTTTCCTCCTAACAAAATTTATTCTATATATAAGAATTAATAAAGAT

TTAAATCTTTTACCACTTGATTAAAAAACATAAATTACTATCAATTATTT

TAACTTTTTATAAAATCATGATTCAGATCTTTATACAATAACATATCTCA

TCATGTGTTAGTTGTTTATATCATCACTCTTTAAATCTCTTGAGTCTTTA

GTTTAGAGGAGCTAAATTCAAAATAGAAATATCAAGAAAGTAACATATGT

GAGGATCAAAAGTAAAGAGACTCCCAACGTGATAAGTCACCCACCACCAT

AATAATACAAATAATAAAAATAAAAAAGACCATACTTTTGTCTTGCACAG

CAGAACGAGTGAAGGTGAAGAGAGTTGACTTAAGCCAAATCTCATCACAT

CAGTTCATAGCAACCAATTCCCTTGCCTTTGTCTTTCTACTCTGATCATC

TTTTGTTCTTGAGATAATGGCTGCAGCACTGGTCGGTGGTGCCTTTCTCT

CTGCTTTCCTTGATGTGCTTTTCGACAGGCTGGCTTCACCTGACTTTGTT

GACTTGATCCTTGGAAAGAAGCTTAGCAAGAAGTTGCTTCGAAAGTTGGA

GACCACTCTCAGAGTGGTTGGAGCTGTGCTTGATGATGCCGAGAAGAAAC

AGATCACAAACACCAATGTCAAACACTGGCTCAATGCTCTCAAAGATGCT

GTCTATGAAGCCGATGACTTACTCGACCATGTTTTCACCAAAGCTGCCAC

CCAAAACAAGGTAAGAAACTTGTTTTCTCGCTTTTCCGATCGGAAGATCG

TTAGTAAGTTGGAGGACATAGTTGTCACCCTAGAGTCTCATTTAAAACTC

AAGGAGAGTCTTGATTTGAAAGAGAGTGCAGTGGAGAACTTGTCATGGAA

AGCTCCATCAACATCTCTGGAAGATGGATCTCATATATATGGTAGGGAGA

AAGATAGGGAGGCCATAATCAAGTTGTTGTCGGAGGATAACAGTGACGGT

AGTGAAGTGTCTGTGGTTCCTATTGTGGGCATGGGTGGGGTTGGAAAAAC

TACTTTGGCCCAATTGGTGTACAATGATGAGAATTTGAAAGAGAAATTTG

ATTTTGATTTTAAGGCATGGGTTTGTGTTTCTCAAGAATTTGATGTTCTG

AAGGTCACAAAAACTATAATACAGGCGGTTACTGGAAATCCTTGTAAATT

GAATGATCTGAATCTACTTCATCTTGAATTGATGGACAAGCTGAAAGATA

AAAAATTCCTAATTGTTTTGGATGATGTTTGGACAGAGGATTATGTTGAT

TGGAGTCTTCTTAAGAAACCATTTCAATGTGGGATTATTAGGAGAAGTAA

AATTCTTCTAACAACCCGCAGTGAAAAGACAGCCTCCGTAGTCCAAACGG

TTCAAACCTATCATCTAAACCAATTGTCGAATGAAGATTGTTGGTCAGTG

TTTGCGAACCATGCGTGTCTTTCCTTGGAATCGAACGAGAACACAACACT

AGAAAAAATTGGAAAGGAGATTGTTAAAAAGTGCGATGGACTGCCTTTAG

CAGCACAGTCCCTTGGAGGCATGTTGAGAAGAAAGCATGACATTGGGGAT

TGGTATAATATTCTGAATAGTGACATTTGGGAACTTTCTGAAAGTGAGTG

TAAAGTTATTCCAGCACTGAGACTTAGTTATCATTATCTCCCTCCACATT

TAAAACGGTGCTTTGTTTATTGTTCGTTGTATCCCCAAGATTACGAATTT

-continued

GATAAAAATGAATTAATCTTGTTGTGGATGGCTGAAGATCTTTTGAAGAA

ACCAAGGAAAGGTAGGACTTTAGAAGAGGTTGGTCATGAGTATTTTGATG

ATTTGGTTTCGAGATCATTTTTCCAACGTTCAAGTACAAATAGAAGTAGT

TGGCCTTATGGTGAATGTTTTGTGATGCATGACCTCATGCATGATCTAGC

CAAATCACTCGGTGGAGATTTTTATTTTAGATCAGAAGAACTTGGGAAAG

AAACAAAGATCAATACTAAGACTCGTCATTTGTCATTTACCAAATTCAAT

TCTTCAGTCTTGGACAACTTTGATGTTGTTGGTAGAGCAAAATTTCTGAG

AACTTTCTTGTCCATTATCAATTTTGAAGCTGCTCCATTCAACAACGAGG

AGGCACAATGTATCATTGTGTCGAAGCTTATGTACTTGAGAGTTTTATCA

TTTTGTGACTTCCAAAGTTTGGATTCTTTGCCTGATTCAATAGGTAAATT

GATCCATCTGCGCTATTTAGATCTTTCTCATTCAAGTGTAGAAACACTGC

CAAAGTCATTGTGTAATTTATACAATCTGCAAACTTTGAAGTTGTGTAGT

TGCAGAAAGCTGACTAAGTTGCCTAGTGACATGTGCAATCTTGTTAACTT

GCGTCATCTTGAGATACGTGAAACTCCTATAGAAGAGATGCCGAGAGGAA

TGAGTAAATTAAATCATCTACAACATCTGGATTTCTTTGTTGTGGGCAAG

CACAAAGAGAATGGGATCAAAGAATTGGGAGGACTTTCAAATCTTCGTGG

TCGACTTAAAATTAGGAACTTGGAGAATGTTTCCCAAAGTGATGAAGCGT

CGGAGGCAAGGATGATGGATAAAAAACACATTAATAGTTTATGGTTGGAA

TGGTCTAGATGTAATAACAACAGTACCAACTTCCAACTAGAAATAGATGT

GCTTTGCAAGTTACAGCCTCACTTTAACATTGAATCGTTGAGAATAAAAG

GCTATAAAGGAACCAGATTTCCAGATTGGATGGGAAATTCTTCCTACTGC

AATATGATGAGTCTAAAATTGCGTGATTGTGACAACTGTAGTATGCTTCC

TTCACTTGGACAACTACCTTCTCTCAAGGTCCTTAAGATTGCACGATTGA

ATAGGCTGAAGACTATTGATGCAGGTTTTTACAAGAACGAAGATTGTCGT

TCTGGGACGCCCTTTCCCTCCCTTGAATCTCTGGCCATTCATCAAATGCC

TTGTTGGGAGGTGTGGAGTTCCTTCGATTCAGAAGCTTTTCCTGTGCTTG

AAATTCTTGAAATACGTGACTGCCCCAAACTAGAGGGAAGTTTGCCGAAT

CACCTTCCTGCTCTGAAAACACTTACAATTAGAAATTGTGAGCTGCTTGG

CTCTTCTCTCCCAACGGCTCCCGCCATTCAAAGTTTGGAGATACGTAAAA

GCAATAAAGTAGCACTGCATGCGTTTCCTCTCTTGGTAGAAACTATAAAA

GTAGAAGGAAGCCCAATGGTGGAGTCCATGATGGAGGCCATCACAAACAT

CCAACCAACTTGTCTCCGGTCTTTAACATTAAGGGATTGCTCGTCAGCCG

TGTCATTTCCGGGTGGTCGTTTACCTGAATCACTGAAGAGTCTGTATATC

TCGGATCTTAAAAAACTGGAATTCCCGACGCAACACAAACATGAGTTACT

GGAAACACTGTCAATAGAAAGCAGTTGTGATTCACTCACATCTCTTCCAT

TGGTTACCTTTCCAAATCTCAGAGATCTTGAAATCAGAAACTGTGAAAAT

ATGGAATCTCTTTTGGTATCATTCTGGAGAGAAGGATTGCCTGCGCCCAA

CTTGATTACTTTCCAAGTGTGGGGCTCTGACAAGTTGAAGTCGTTGCCTG

ATGAGATGAGTACTCTTCTCCCAAAGTTAGAACGTCTCCTCATATCCAAC

TGCCCAGAAATTGAGTCGTTTCCAAAACGGGGTATGCCACCTAACCTGAG

-continued

AATAGTTTGGATTTTCAATTGTGAGAAACTACTGAGCAGCCTAGCATGGC

CATCCATGGGCATGCTTACTCATCTCTATGTTGGGGGTCGATGTGATGGC

ATCAAGTCCTTCCCTAAGGAGGGTTTGCTGCCTCCCTCCCTTACGTATCT

GTATCTAAGTGGATTCTCAAATCTGGAGATGTTGGACTGCACGGGGCTTC

TCCATCTCACATCCCTGCAACAATTAACCATAGACGGATGTCCTTTGCTG

GAAAATATGGTGGGAGAAAGGCTTCCTGACTCTCTAATAAAATTAACCAT

AAAGAGTTGTCCTTTGCTGAAAAAACGATGCCGGAAGAAGCACCCTCAAA

TTTGGCCTAAAATTTCCCACATCCCTGGCATTAAGGTTGACAATAGATGG

ATTTAGCCACCAAGGAGGACCAACAGGTATCTTCTAAGTCTAACCAACTA

GAAAACTAGTTCTGTCAAGGATATGTTTCATTTCATGTCTTTCTCCTTTT

ACGTTTTACTAAATCCAATTCATTCTGAAATGGAAATTGACCTTGTATAT

ATGTTACTGAATCTACAGAGAATCAACAAATCATCAAAGGCAACGTGGAA

ATTGACCTTGTATATATGTTTCGAAGAAGTAACGATACAGGTACTAAGTA

ACAACATTGATAAATACTTAAATATAATGATTCTCCGGAAAAATGTTACA

CATCAGTATTGTTATATTCTAACTTAATTTCTCCTTAAGATTATTGAGGC

CAGAGTGAAAATGACCGTGGGAAACTTATTTTTGTTTTTCAGATATGGTT

GATTGGCCCGGAGAAACTGTACCTACCCATGAATCTAAGTTCAAATTTGA

ACTAGTGCTAAATGTAACTTTTAATTTAATTGACGTCAAATTGACACTTT

CTCAATAGCTAAATTTTTATTTGTGAGGTTTTTTGTTAGGTACAATGTGA

AGGATGAAAAGGTGTACCAAGTGAACTTTAGAAGGATTGGATGATTTCAG

CTTATCTCTTATCTCCTGTCCTATAAATTAATAGTGGTATGATTATTCTA

AAAATATGATAGATATGTAGATACGTAAGAATTGATAAAAGCATAATAAA

TATACAATTGCAATTCGGTAAATTGAAGAACATACATACTTCTTAGACAT

TGCTAAAAACAAAATCAAAAAATTGTAGATCATTTTTTCCTATTGTTCAC

AAATAAGAATGGTACTATCAATGATCAATCTCATTTCTTTCTTGAAATTA

TCTATAAACAAAACAATTTTCATATTTGGTTCATCAAGAAACAATACTTT

TTATATTTCTATATTATATTTACTTCTATGTTACATGTCACTATATTTGA

TTATCATAATTTTTTTTTAAAAGAATTGGTCACTTTACATATATGTACCA

GTGAAATATATCAATATATTGGTATCGGATATAGATGCATGAAGCAAATT

AAAGTATCAGTACTTTGTAGCAAAACACATTCTTCAAATCATGACATGAG

GTAAAAAAATATGATGATATTTTTGTAAGTATTGGAAAAAAAAAAAAAAG

TAAAGCTTCTGAAATCAAAGAGACACTAATTTTCCACAACATCCTTCAAT

TGGGCCCAAGCTTCCTTTCCTATTGACAAATAACTGGTTGTTAGTGCCAG

CTTTTTCTTTTTTCTAGTTTTCCATTGATGGTTAAAAGCTAATATGAACC

TGTCACTCCTTAAAATTTCCACCAAAGTTTGGTAAATAAATATATAGGAG

AGTGAATAATGCAAGCCTTGCATTCTATCTCTAAGTTACTAGGTATATGA

AACAGGTATGGGTATGGTTTTAGAAGGTATGTGGTTCATCACTATTTATA

TTTTTACTACAAGAACCAGGTAAACTTTATTATGGTACAGTAAATTTAGT

GTGAGGTTGTAACTACGTTATATCCATCTAACTTAGCACGATAATTAAAT

TTAAAAGCAAAAAGATAAGAAAAAGGCCAATCTAACAATTGTTACCTCTC

-continued

TTGCATGAAAAAATCAGAAACAAAAGCCCCACTCTTTCCTCCATGGTGCC

TGTAATTAACAAGCACTTCAAAAATCAATGTTAATTAATTAATTTCCATA

AGAAAAAAAAGACAGAAGCTAATGAAATTTAAGGGGTACAACAAAGATTT

GTAGAACGATCATTAATATTAGTGCAACACATCATGATGAAGTGCATGAC

ATAATAATAATGTGAAACCAATCATGATAAGAACAGAAAATAAATCAGTG

CAATTACATGATTAGAAAATAAAGAGGCGATATATCATATTCCTATTGAT

CAGACAATATGACAACGTGTTAAACAAATGTGTCAGGTGCAATAATGAGG

GGATAGAGAAGAGAAGGATGATAAAGAATGTGGTTATGACTTCTACAAAG

TCGAATTATTTACTTTTTTAATTTTTTATATTTTCCTTTTCACTTTTCTA

ATAGTTGTCCGATTAAGAGGAGTTTATAGAGTAGATTAAATTGGTTTTGA

AAAAGAGAAATATCATCTTATACAATTTTTGGTTTTCTTAATTCATTGTT

CAATTGATGTAGTTTAAAATTTAAATATGATTTAATAAGTTTGGATTGAT

CTCGATCTTAAGTTTTAATTTTAATTCTATTTTTTCAAAAAAAAAATATT

AAAGATATATAATAACTGTGATACAAAGTAATTTAAAATATTTTACCAAA

AAATGTAATTTAAAATATCACATATATATAAATCATTTTAAAGCTAATAG

TAATATTTTCTAAAAAGAAGCTAAAAGTATATCTCTGTTATACAAGTTGA

TAATTATATTTATATATACTTGAATAGTTACTGAATATTATATTTAATTA

AATTTACTTTTCATAAATAATTTTTAAGTAATGTAATAATTTTTTATATAT

ATATATATATATATATATATATATATATAATAAATAAAAATATAAACATC

AATGATATCATAAAATTTTGGTAATAATAATTTTTAAAAAAAAATTGTGA

ATTAACTAACCTTTCAGGTTCTAGAGTAATTTATTAATCCAAATTGCCTT

GAAGCATATTCCCATGCAAGTCAAGTTGAGGGACTTGATGGAGGCCATTT

CTGAAATAGAGTTAGGAGAAGTTATTTTCAGCCAACGAGAGATTCTGCAA

GCTCCCTAATTTACCAATTCCCAATGGCAAGGATGAGGAAAAGAGTTTAT

AAGAGATATCCAAGAATTCAAGGCTTTTGAAATCAGCAATGTTGTCAGGT

AGTGTTCCTCATATGGCAAGGATGAGGAGACTTTATTTCATGTAAAAAAT

ATTTTCCTAGGAGTATATATATGATATATGATTATGTTGGGTCATATTTA

TGGTATCTCAAGGTTTCAATTGACAGTTTTGGCTATCTCGGAAATTTTCC

TTGTACCAAAATATTAACAATTGAAACATGTTTCAAATCCAGTTACTTTT

GGTACCATAGAATTGAAATTAATTTATTTCAAATACATTGTATTCTTAAT

ATATTAAATATGTTAATTTGTTATTTTTTTTAAAAAATAATCATTAGAAA

CAAGTTCCGGTATAGGAGGCATACTTAGTGTTTAGGCTAAGGAATAATGC

CACCGGGTTCAGGAACAAGCCTGTTGAGGTGTCCCTTAACGTTCCGTGAC

ATCCCCACTCTTGCATGGACATTCTGTGCAGAGAAACGATGGGTGGATGG

AGGTAAGATTGGGTGAGTTCTATAATAGTCACTGATGAGAACCCCAAGAG

CAGCATTGAAGTTCGAGGAATCCAAATAAGACCAGCGTAAATTATCAATT

TCATCTCTTAAATAGTCACTAAAATAAAATATAAATTAATTCTTTCAAGT

ATTGAAACATTCTTCAAATTAATCCTTATACATTGATAAAATATTTCAAT

GTATATATGCATTAATGGATATTTAACACTTTAGAAATTACTTATATATG

ATTTTGTTATTTTAAGGACTATTTATAAGAAAGAGTAATACTCTAGATAT

-continued

CAAATTGGTAGTTAATTTAATTACTCTTGAAATAAGCATGCTCAATTTAT

AATATGTTGTTTTGTTGGCAATTAAATAAGCACACCCTCTCTAGAATGGT

GTGTATGTACTTTTCTGTATATGTTGTTTTGTTTGTATACTTTTGCTTGC

ATAGATCCCAAAACAATTGGGTGATTTTCATTCTTCTATAAATTTTCTTA

TAAATATTTAAGAAATTTTTGCTAACACAAGACTGGTGATATGATGTTAA

GATTGACATAACAAGGACGTGAGAGTTCAATTTTTCACATGCCATGTCAC

CCATCATAGTACCTTGTTGGCATGTATTAAGTCAACAACAAACTTCCATT

TTAACCATATCTTTGATCACCGCAAAAAATTATTAAATTTACTATTAAAT

TGTTTATATTTATTTTTCTTTATTGTTGGGCTGAGATTTTTTTAGTTACT

AAAATTATAAAAGTTTTTTTAATCTCTGAATTTTGATAAATTGTTCTTTT

TAGTTTCTGATTTAATAAATTAATATTTTATAATAATTTTAAAATGAAAA

ATTCAATGGCTAAAAAATAAAAATCAATTAATGGTTGCTAAAACCTAAAG

GATGTTGCTAATCAGTGCCCTAAGGCATTAGTTAATAAATTAAAATAAAA

AAATATTTATTATGAAAATCATAAGAGTATGTAAAAAAAATCATAAATAA

TACTATTTTATATATTTCAATAAAAAAATTATTATTTTAGTTCTTTATAA

CCAATTAATACCTTAAAAACACTAGTTAACATTTAGGATAATTAAATTAA

CTAATTTTGAAATAAACTTCAATTATTCAATTATGTCTTAATAAGCTTGA

TTTTTCCCTTACTACTGCAAGTTTGCATCCTTTATTAAAGTGAAGTGATG

AAATGTTGTCTGCCATTTACGAATATCACTGAAATTAAAGTTGTTTTCTA

GTTGAATTTATAATAAGTTTTTTTAATTGATAAATTTTAATCGTTATTTT

GTGAGTTTTTGTTAGTATAAGGAAGTAAAGTCACAAATTTTCTTTTCTTT

CATAATTTTTTAACCATCCCATCAATATTATATCTCCATTTACAATAAGT

TAATAACTAGCAAGATACCCATACATTTACGCAGATCGCTCTCCTTTTTT

ACGCATATTCAAAATACACTTGCTTAAAAAAGATAATTAGCTATTTAGTA

TTTATATTCAATAAACATGAAAAAAGGATTAGAATATTCAAGCAAAAAAA

AAATCAAAATCCTAATTTTTAGGCTATTTAAATCATTGTCTTCTATTATT

TGAAAATTGAAACTATTATTCATATTTTTACCTGTTTTATCTTCATAAAT

TCTATTTTAATATATTTATTATGTATTTATGTAAAAAAATCAACACTATT

AAAATTAATTTAATTTGTGATATTATTCAGTATTTAATATTTTGTTATAA

AAATATATTTAATAAATTAATATTAAAATATTTCTTATATAATTATGAAA

AAATGATATTTAAACTTATTTTATAAATATTAGTTAATAAAATTTCCATA

TATGAAGTTATTAAAAAAAGAGACAAAATAATATTTTGTAATAAACATAT

TACCTAATTAGATTTAAATTAATTAATAGTATAAAAATTTCAACTACATA

ACATAAATTATTCAAAAAATATTTCATTCATAAAATTATTTTATACGGTT

TCTAAGTAAAATTGATTTTATAGGATTTCAAATTTTTAAAAAGATATCGT

GGATTCTTTAATATGTTGTTATGTTAAATATTCTTAAAGAAAAAGCTTTG

TCACCCATAATAATTGGCCTGTAATGACGTTAAACACGTGATTGTTTTTC

ATGAATGATATTTTTGGTCTCTATCATAAAAAATATATATTAATTAAATG

TATTATTGAGTAAGTATTTTAAAAGTATTGTATTAAAAATTATATTTAAT

AATTAAATTTTAGTAGTTATTATATATTATGTAGAAGTGATTATAAAGTA

-continued

AAAATGGGTTTTCAAATTAAAAAAAAAATATTATTTTTACTCTTTGATAT

ACAATTGTGTTAACTACTAGGCGAAAGAACTGTGTCATTTGTAATAATTT

TGAGTAGGATTATTTCTCATCAATGATTATTAAGATCCCTGTCATGATTA

AAATGATTTTAATTTATGATATTATTAAGTTTTTGATATGAATTTGTGTG

AAATACTTGAAGAAAGAGCATATTCAGTAAGTAACCTAAAACTATTTTGT

AATAAAAATACATTTTATAAATTGATTTTAATATTTTTATTACTACATAT

TATGTAAAAATTAAAATTAATATAATTTATGATTTTATTGAGTAAGTAAT

TTAAAATTATATTGTGATAAAAATATATTTAATAAAATGTTATATAATTA

TGTAAGAATGATTTCCAAATAAAAATAATATTATAAGATTTGAAAGTAAA

AAAAAAAATACTATTTCAGTTTTTTTTATGTGTAGTTGTGTTAACTACTT

GGATAAAAAAAATATTGTGGTCTATAATAGTCTTTGGCAAGATTTTCTTG

TCACTAATCATATTTGTAATCTCTAGCATAACTAAAATTATTATAATATA

TGATATTATTAAGTCTTTTGGTATGTAGTTTTATAAAATATTGGAAGAAA

TAGTTTTGTTGCATATAATAATCCAATTTCGAGTAGGATTTTTTCTTATG

AATGATATTTATGATTTCTACTACAAAAATATTTAAACTAATTAAGTTTA

TGAGATTATTGACGAAATGATTTAAAATTAGTTTTAATAAAAATATATTT

AATTAATTAATTTTTAACATAGAGTCAAAACATTATTTTGTAATAAATTT

GTTAACTAATTAAAATTAAATTTATTTATAGTATAAAAATTTCAACCTTA

TAATATAAATATTAATGAATAAAATATTTATTTATAAGATTATTTAATTT

TATTTTATATGATTTCTAATTAAAACTAATTTTATAAAATTTCGAATTAA

AAATAAATTGTTGAGTCTTTAATATGCAATTGTTTTAATTACTCGCGAAA

GAGTTTTTTTTTCCTATAATGGTTGGCCCATAAGAAGAATTATTTTTAG

TCATTATCCCAAAGAGAATAAAACTAATTTAATTTATGCTATTTCTTAGT

AAATAATTTAATTTTTTTTAAAATAAAAATACTAAGTGACTAATCTTCCT

CAAGAATTCTGAGTGCACATAATTTGACTATTCCCCTCCCAACCCAATTT

ATTTCATACACAAGGATCAACGGGGACTAATATATTAATTTTAATATATC

TATTATATATTTACTTAAAATGATTTTATAGAATTTAAAAATAAAAATAA

TTATTATTGAATTTTTGGTTTGCATTTGTGTTAACTACTCAGGGTAGGAA

CATTGACGTCCATAATGACATTGAGTAAGATTGTATCCCATCAATGATAT

TTGTGATCTCTATCATATTTAAAATTATTTAAATTTATGATATTGTTAAA

TCTTTAATATGTACTTTTATGTGTGTTTCGTTGCATTTGCACATAAGATC

TCTAGTAGGATTATTTTACTTGAATCATCCAAGGTTGTTAAACTCATGTT

TTAAATCGTAGAATTGTATGATTTTACGATTCCACTAAGCTTCAGCGAGT

TAAATCGAAAGCAGAATTGAAAACGGAATAGACTCATCTGATTTAGCGCA

AACTTGGGCGAGTTTGGGTAGACTCGCGAGTCTGCTACGAGTATGTGGAT

TTACGAAAACCCGAAACGGTGTCGTGTTGTAGCTACTTATTTGAGTAGAC

TTTGTCTACCTTGTTCGAGTTATGCAAAGTGCAAAATTGTTTGGTTCATG

CTTCTTGGCTTCTTGCTGTGATGCAGTCGGTGCTAGAGTGCTACGGTGGG

GTGCGACGGTGAAAGGAGGTTTTCGGTGTTGGAGTGCGACTGTGCAAGTG

TGTGACACAGTGCTTCTGGATCTTTTGTTGGAAGGAGGTTTTCAGTGAAA

-continued

GGAGGTTTTCGATATATGGGATCAAGGTGATTTGTTGCGAACAAAAGCTA

AACTTCAAATTGCACAGGGCCAGTTAAGGAACAAAAGCTATACTGATATA

CGCAGTTGCTAGTTGTTCTTCAAATTCAGAGTAAAGGTTTTAATTTGGTT

CTGGGAAGAAGCTATACAAGGTTTGTTGTTGTAATAACTTATGCTGATTG

AATATTTCTGAACCATGGGCCTTTATTCCTGTTATTTACTGTTAGAATTG

GATGAATGCAGTCTCATGAACCTTTTGAATTTATTAGATTTTTCAAGAAA

TTTGTGATCATGGGTTTGTTAGAAAAAAGGAAGTGTCCTGATAGTTTGTA

CCTTAGAAAGTGAGAATATTGATATATAGGAAAGTAATAGTGAGAGTATT

GAAGATTTGATCACCATTTTATTTGGTTTGAAATGGAGGCATTTCGTGAA

AAAGTAGAGTGCAGAATGCATAGAGTTCCTCAGAATTTCGCATGTGTTGA

TGAAGCTTTTTGAAGCATGGTACACCTTTAAGGGCATACTACTGTTGGGT

TCATATATTTTTTGGTTTAATGAGAGAATTGAAGATTTGATCACCATTTT

ATTTGGTTTGAAATGGAGGCATTTCGTGAAAAAGTAGAGTGCAGAATGCA

TAGAGTTCCTCAGAATTTCTAACATACTACTGTTGGGTACACCTTGAAGC

ATATTCCCATGCAAGTCAAGTTGAGGGACTTGATGGAGGCCATCTCTGAA

ATAGAGTCAGGAGAAGTTATTTTCAGCCAACGAGAGATTCTGCAAGCTCC

CTAATTTACCAATTCCCAATGGCAAGGATGAGGAAAAGAGTTTATAAGAG

ATATCCAAGAATTCAAGGCTTTTGAAATCAGCAATGTTGTCAGGTAGTGT

TCCTCATATGGAATTGTTGGACAAGGAGGGTTTCACTACTGACAAACTGC

TAACTCAGTTGGAGAATGTTGTGTAAGTGTTAATGCAAAGGACAATACCG

AAATGCATGAAAAGATCATCATCTCATAACAGACTCTTTCACATACGACC

GACCACCTCAACTGCAATGGCATATTTTGGTGAACGAAATTGTTCTGACT

CACGTAGATTCAAAGTGAATATTCATAAATCAGGCATTTTCTTTGCTTTG

TGACAATGTCACTAAACCTTCAATTAGTTGATCTTGTTCTAGCTCTATAG

GGTAATAAAAGTATATCAATGTCTGCAAAATACATCAATAAGATCAAGAC

ACCAAATATATATATGTGCTTGAATTATTTATAAACTTTTATTTTGATTC

CGGGTTACAACTTATCTTAAAATATTTCTTTTTTCTCTGTTTCTTCTTT

CAAGTTTTTAATTTAACTTCCTGGGTAATCTAGATTCCATAAAATACTTC

TGGAAATGCAGATATGATCTTGTTTTTTTTTTTTGTATTTTACTATTCTA

TATATTTTATATTAGTGTTGTTTATTTTCTTAAAATTATCATACATAATT

ATATATGCTATATACTTGTTGATAGGGAAGAAGATAGAAGCTGGTTTTCA

AGGACCAGGGCCTCCACGGAGAGAAGAATGAGAAGAATAAGGGAAGGAAC

AATTGTATATTCCATTGATTGATGTTGTTATTACATAGTATTATTTATAC

TGATTTCTCAATAATCGAATTTGTCTTTTTGTGCTACAGAATATCAGGAA

ATTGTTAAGTTTGTCTATTCCTACCCGACCAGCATCATTCTTCCAGATAT

GATGCACCTGCTTGTTTCACACCTAATCCTTGAGGTAAGTGGGTCTTGTA

ATTGCTCTCTTGGTCTTGTTTTCTAATTGCACCCCCTTGCTTCTGTTGCT

TGCTTGCTGCAAGTTCCCACTGATTCAAATTCCAACAGTTCTGCAAATAA

AATTGAAGAAGAAGCTAGAGGTGGGAAATACTCAAGTCATTCTCTTGAAA

AAGTTGCTGCAATGATATGCAACAAAATATCACTATACGGAGTCAAGGTA

-continued

ATTATTGTGTTCACATGAACATTTCTTCCATGAAAATATATATTTTTTTA

CTTTGTAATCTCTTTATAGTATGCATGGAAAATTAATTTTCTGATTTTTT

TCTCTGTAGTGTTATATATTATTTTTAATCACATTTTCTTATTTATTAGT

TTGTTTCTTATTTGACATCATGTAAATTTGGAGATTTGGGTTAGAAATGT

TTTTGGAATTTTCCTGGTTAGAACTTGATAGGTCCATAATGAAGGTATAT

AAAAGGATAGGGAAAAGAGGGGGTGGGGAATAGAAAAAGAAAGGACAAAT

GGGCCTCAGAAACAAGACATGCTTGTGTATGACAGCAGAAAGAATCAGCC

GTACAAGTTGCACTAGCTGAAGTGGAAAAGGAACATAGGTTGGCATAATG

GAATGGATAGCATTTGATCTTTAATAAATTTTTGCTTTGTAATAGGTTCC

TAATATTTAAAAAGTTTTGTTTGAAATACTTATCATTAGTCAAAATCTGT

TATTTGCTCACACGATCGTTAACCAGCCACACAGACATGTCATGTGTGAT

TTTTGTCTGACTGAGATTAGGATTAATGATAAGAAACTATAGTCAAAATC

CCTTGGGCATAAAAGAATCATTCTTCAGCAAATAACGGATTTTGACTAAT

GATAAGAAACTATAGTCAAAATCCCTTGGGCATCAAAAAATCATTCTTCA

GCATTCCTCTACGTTTTCACACAACCCATTATAGTTTCTTCTATACCTTT

CTTATGGATTTGTCACTATGACTTCGTCACTCGTGAAGATCCAAGGTGAA

GAGGTCCTCACCAACGATTTTTAGGATCTTGCAATCAATTTTACATTTTC

AAATCAAACCAAGCCAACTCCCAACTCAAGAAATTCACATGGATAAGGTT

TCTAAGAGAACACATCAAAATAGTTTCATGGGTAGAAGAAGGTCAACAAA

ACCTTACCCTAAAATGCGATTCCGCTCGGTCCATTGCATAGAGCACGAAA

AAATGAGTGGGATAGCGATGTCTGAACTTGTCGTCGACCTTTCATAGTTG

CGAGCTCTTTTTGCAAACCCTTGCTTTCATGGTTGTCTCTTCTTGTTCTC

CCTTCTTAAAGGTCACCACCAACCCAGCCATCGGCCACCACTGGTGTTGC

CAGTCGTGCCACTGCTCGTGCCAGCGCCAGCTACCACCAGTAACTTCCTT

CAACTCTCAAACCTCACTTCTCTCCCAGTCTCTCTCTCACACTTGGCCCT

CAAACTCACTTGTGTGTCGTAGGTGAAGAGAAGGAAATGATGAAAACAAA

GAGGAGGGTTTTCTTTGGGGAAGGGGGGTCCATGAGTGATTTTTTAGAGA

AGGAGATTTGTTGTTGCCATGGGGAGCCATGGTTCAAGAGAAGAAAAAAA

GAAAATGGGTTAGAATTATTGTTGTGTTGCTGCCATGGGGTTTCAAGGGA

GGTTTGGGGGGTTTTGGAGACACAATAGCGGTGGTGTGGAGCTAGTGGAG

GAGTTGGTTGGGGACTGGTGGGGGTGGTTTGGAGGATTCGGGGACTTAAT

GATGTCGTTTTTTTACTTTTTTCTATAAAAAAATAAAAAATCTTACGTGA

TCGGTTATCGATCACATATGAAGATAATGGATTTCGACTAACGGCAGGAA

CTTCGAACAAAGCTTTTTAAATATTAGGGACCTATCACAAAGCAAAAATT

TATTAGGGACCAAATGCAAAAAATGAGTATTTATCAGAGACCAAAAATAT

ATTTAAACCATTACCTAATTGCAACTCACTATGTGATAAGTTTGTTGACT

TTTAAAATAATTATTTTAAAGTAATTCAAACAATAATTTATAATAGTGTA

AAATCATTTTACATCATCAATACATAAGTATTAAACTCGATATCTCTCTC

TATATATTTTCTGTTCGAGATTGATTGAAATTATCTTATTTGCTTAACAT

ATTAAAATGCGTCATTTTTAATGATATTATTGGTCTATAGTTTTTATGTA

-continued

ATACATTTAATAATGTTTAGAAATATTTGTATATAAATAACTTTTATCTA

TTTTTTCACCAGAGCCTATGAAATGTAAGCACAGGTTTGTTAATGAGTAG

CACAACATGGACAGTTTGTCAAAGGCCCAATAGCATCTTTAATGGGATTC

TTGAACTCAAGAACCCTATCCACTAGATCTACTATTATTCTTATTAAGAG

TTTTTTAAGATGGAGATTGGGTTCTAGGAAAAGAACTACTATTTTTTCAA

AAATATTATTTTTTCTTGTGCTAGTAAAATCTAATAATCCAAATTGGATT

CTACTATTAGAATAACAAATGATAGAAGTTCTTGCATCCTATATAACATC

ATGGGACTCACAAAAAATAATCCAAGAACCTAAAATGGATTCTTTGACAA

AAATGTTCTAAGAATCTCAATATTTTCCCACTTAAGAAATATAACTATCA

AATCAATATAATATGAAACGAGTTCAATCTTTATTGATTCACTTGACGCA

AGCTATATGCACAACTGACATAATAGATTTTAATTCTAAATAACATGCAA

TAAAAATATAACAAACCTGTTCCGGAAAAAGCCTCCTCAAAATGAAGCAC

ATTCAGTCCCCCCACAATTTTTACAAGTTGGGGTCTTTATGCTGCATCAA

AATATTCCATCATATCCCGCAAATGTTTCGTGCTATTAAGTTTATGTTAG

TTGTCCCTTCATGATGCATCACCAGCATATCATAAACAATCAGTTAATCC

CTTATTCTGCCGAAATAGTCGGATTATCGTCAATCCCCCTTAAGGTGGTC

GTTTGATCCCGCTTGGCAAGGCCCAACTTTGAAAGTGAATTGACCTAAGC

CTCTTTTATGGGCTTGATGCGTGATAGAAGATCGGAACATAATCCAATAC

ATTCCAATCTGAACCAAAAGATAACCCCTTAGCTTCAAGCACACAGTGCG

TAAAAGCTAAAGATGTAGAAGATCGGAACATGATCCGATCTAGACCAGAA

CAAAACCTAAAACCAAACTACTAACTGATCTATAATTTTTTATACATCAT

AAAACTAAAAAAACAAAGCAAACTAAGCACATAATCTTACAATCCCTACT

GAATTTACTAAAAGAGACACAGATAGTTGAGGTGGGAAATGTTGCCAAAC

CAGAAATGAATTATCACGGGAAAGTATGGCTGATGTGGTTACAATTAGGA

GTCTTAATTCATCTTAAAGCATTAATATTTTTTAACTTAACAAATATAAT

TAAAGAGAAGTAACGAATAAGATAATGATCTAAAATTCTTGTATTGATTG

AAAATAGCGTAAAAAGATGTTTCAAAGATAATGATACAAACTCTTTAAAT

GCAAATGGTTACATGCACAAAGCACGTATATATATATATATATATATATA

TATATATATATATATATATATATATATGAATATATCTACGTACATTCATA

TATGTATGTATATGCAAACATATATACATGGATGCATATATATATATATG

CACTAACAAACATATATACATCTGGATAGAGAGAGGATCAGAATAGCAGG

ACAAAGACAAACTTGTATTTGTTGCTTCCATACTAGAATTGCATTTTCTT

CAGGGTTAGATGCATCAACTGTGTGGGAGGGAAATTTATTAACAGCGCTA

AGTATTCTCCTAACCTTAAGCAGGATCTCCTTCTGGTCTCTTGCCATCTG

AGCTTGCATGTCAATGATGAAAAACCTGACAAGCGAGTCCGCAAGTGCCT

CAAGTTGTTCCTGGTAACAAGCTTTGTCGCATTGACCGAAAAAACCAAGG

TGACGTTGACCAAAAAATAGTCCTGACAAGATGTTGGTAAAAAAATATAA

TCGGTTGATATCGATCACAAACATCATTGACTAAGGTTAACAAAAAAATT

TCTAACCGACATTGATCAAAAAATAACTTCGACCAAGGTCGATCAAAAGA

AACGTAACCGATTTCGGCCAACAGAAATATTTTATATGATAGCCTTTAGT

-continued

TGCAAAAAGTGTGAACCAGGGGGTATTTTGACAGCCGTAAAACATATCTC

ATGGCAGTGGTTGTTATATAAGGCAAAAAACCATGAACTTTCTTCTCTTG

CTGGTGTTTGGAGCCACTTCAAATGTGATTGATGTTAGAGAAGTTAACAG

TGGCATTTTTTAGGACTGAAAGTTAACTTAGGAGAAACCATTTTTTTATG

TATGTAATACGGTAACACATGTACCTCTTGCAGAGATTGGGGAGAAATTG

CAACTTTTCTTTTTACATTTTGCCTTAAAAAAAGTGTTCATATTTATAAA

AATAATTTTCTATTTAACTTGGATATTTTTTCTCATACTACTACACTAAG

GTATATACAACCTAAGGCGTGTTTCTTAATTTGGAGAGTGATGCTTGATT

GATTGACTACCAACGAAGGATAATCTAAAAAGGAGAAACACCATTTATAA

TCCTCATGAGTGCTTATGTCCCTTTTGCCTTGAGGTAGATGAGTCGGTAT

CTCACTGTTTCTTCTCATGTCATAAAATTCTTGGTACTAATTTGGAGGCA

ATGTTACTCTTGGCTGCTGGCTGCATGTAAATGTGGTGTTGCCACAATGA

CCAGAATCACATTTTTGGCAAGATTCTGTATTCGTAAGTTCAAAGAAGGA

GGCAGATGTATGGAGGGCGGTGTGGGCATCAGAAATTTTGGTGTGTATGG

AATGCTAGGAATGAGTGTATGCTAAGGAATTAATGGCTCTTTCAATGCTG

AGAAAATTACGCAGAATATATTATTCTTTGCACGATCGTGGATTAATAAA

AGCCAGAGTCCCTAATTTTAATTATTGTTTTACTTAATGATATATGGCAC

CTGGAGCTTGTTTCATGAAGAGACAATTTTGAATGAAATGTGAAGTTAAT

TTGATTCGGTGGTAGCTGCTCTTCGAGTGGGATCATCCCAAATGCAACCG

ATGTTTATGTGCACGATGGTGGGGGCTGGTTAGTGATGCCGCATCAATGT

TGCATGGCTTTAGACATGATTTTAAATTGCAATTATGATTGCGTTGCATG

CAACGAACCTAAAAATCTTACATTGTGGATAATTATGGAAAAATACAAAC

TGATGTGATCATAATTATAATTGTGATGTGATTACAGAGTCAAAATACAT

TAGCGTTATGACTGCAATTATGGTTGCTGACTACATTTTAAAACCATGAC

TTTGGGTGTAATGGTCCATGTTCGAAGCTAGCTATCTTTCTTTCTACTGT

CACTGGTGTATATGTTTTTGGATCTTAGGTAATTTTGGTACCATTTAATA

CAAATCATTTTGTTGGAAAAAAAATACGGTAGCCTACATGCAATATACAA

AATAAAATTGAATTACTATATATTATCATAAATAGTAGAGTATAAGAAGT

AAAGAAAATTCTAAAGATAAACATGCATTTAAAAACATATGAAAGAATTT

TTTAACTATATATATAACATCTTTAATTAGCTTAATAGAAATGCGAAAGT

ACAATAAAAAAGCAAAAACATAATAGGCGTGACAAATCGGTTGCTTATAT

ACAATAAAGACAATAAAGTTTGAAACTAAAACCTTATCCAGACTATCCAA

ATATCCCTAATTAATCATGAAAAAATTAGAACAGAAGACATTTAATAACT

ATAGCAACAGTAACAGCAGCAGCTATAGCTAATGGCGCGATCACCGAATC

GGAAAACTTTTCATCATTGAAGTATTCTATTTCACTAACCCTAAGCAAGA

TCTCAAGTTGATCGCGTGCAATAAGAGCTGGCATTTCAATATTGAAAAAC

CTCTCAATTGAGTCTGCAAGATCTTTAATTTTAGTTTTCCACGGTAAGAA

TTCTTAGCCACAAAATTGTATTTCCCTATTTTTGAACACTTGTAAACAAC

CTCTTTGCTCTTCCTCAATAGTTGTATCAGTGGCTCAAGTTCCTGCTGTG

AACGACCCAACATATTCCTGTACTTACCTATCTCCTGCCATGTTTACGCT

-continued

ACATATTTTCTAGAATGTTATTTGAATTTCATTAAAAATCATAAGAAGCA

AGTTTGAATTTTTCAGTGAAATTTTTACTTAGGTTTAGTTAGACAAACCC

TATTTAAAGCTATATTGTTTTGCTTATCGGAACCAAACCAATTAGTTCGG

TTTGAATTTCTTAGTTAAATCAAGTCTGGCTTAAACCAAATCGAGCTAAC

CCTAGGTTAATTGTTTCAAAGGTCGGGTTGAAGCTCTTAAACTTGAGAAT

GTGTTCTACAAACCGAAGTACCTTATTATTTAAAGAATATCTAATATTTT

TTTGTTTTTACATTATTGTTGAATCCATTTTATATGATTTTTTTTTACA

AAATATTAAACTTTATTTACTAAATAAGATTTATATAAAATTCATGAAGG

TAAAAGTAATATTTTTATCTTTTAATGTAAGGCTTGGTTTCACTTTCGTC

CTTCAACTTTTTTTTATTTGATTTATTTCAGTGATCATTTAATATTTATG

GATTCTTCCTTAAGGAATCTTGATATTTTTCTATAGTTTTAATTGTTCTT

CGGTTATTTATTCGGAAATTGAGAGGGGATCATCACCTCCAAAGATTTCC

TCGCTCCCATTAACAAAAATGTCTAAACAATTACCTTCCTTCTAAAATTT

TTGTGAAGTACCTCCACTAATTAAACTCAACATATTCTCCCAAACTTCAT

TTTCTTTGAAAACAATGTTGTCTAATTCAAGACGCTTTGATATAAAATAT

TTAGTCGCTAGAACGAGAAAAAAAAATTGAATAAAAAGAAGGGATTTTTTT

CTTCTTAATGTACTTCATGCTACTTATTTGTTGGCAATCATTATTAATAT

ATATTATCTTATATGAGACAATTTCAACATTTAAATGTTAATTTTGTAAG

TATCTTGGTAGTATCCTTTTTTGATAAGGAATAGATATTATTTTGAGATT

ATATTATGATGATGAATTGTCTCATAAAAACACGAGGCAAGCACTTGAAA

GGAACAAATTCTCTAATTTCTTAGTGGGTAGTGGGAGAGAGGAAGTAAAC

TTGCTTCAATATGCAAATGACGCTTGACGCACTGTTTACAGGAGAAGCAA

CCATTTCTAAGGTGCTTACCATAAAAAGCATTTTGAGAGGCTTTGAACTT

GTCTCGGGCCTCAAAATGAATTTCCATCAAGGCTTTTGTGGTGCCTTGGG

AGTGGATATTGATACCTTGATGAATTATGCAAGCTTGTTGATTTACTTGA

GACAAACTATATGCACAACTGACAAAATGGACTTTAATTCTAAATAGCAA

TAAAAAGATATATAATAAACCTGTTTCAGAAAAGGCTTCCTCAAAATGGA

GGCTACTTCAATCTAGTACGGTAGTTGACTTACTAAGTACGAAACAACAA

ATTATTAAGTTGATAATTAATTAAACATGATTTTAAATACTTACATATTT

ATTCACATGTAACTATAAAGATTTAGTAAGAGCATAAATAAAAAAATGTTG

TTATAATATATAATTTTAAATTTAATATAATAAAAATGTGTTTGCAAAAT

AGAAATATAAATATAAAGCGTGACAACACATGTTTTTCGTTAATAATAAT

AATAATAATAATAATAATAATAATAATAATAATAATAATAATAATAATAA

TAATTAGAAATGGGTTTTGACAAAATCATACCTGGCGAAAATATGCAGTT

TAGTGACGGAATTAATTTGTGATTCATGCAATACAATTTGTACCAATCAT

CATCATCATCATAATCTCTTTTTCGTTTTATTTATCAACGTTGCTACTTA

GTACGAAAATTATTTGCACAAAATACAAACAGAATGATGCTATCTGTTAT

GAAAGGTAAATCCACACGAATTACACGAAATATAGAATGGACGGTTATGA

TTTTATAAAATGAATATCGATTAAAAAAATTTAAAAGGCATGTAAAAAGA

GATTTACAGACATCAAACTTCGTGCGACTTTTACAAAATCCTCTTTCCTA

-continued

ACACAGCATTATATTTTCCATACACAAACCGTAAACTATAGATTCTAAAG

GGTATACCTGACTTATTAACAACTTTTTAAAAACTAATATTCATTAAAAA

TACCAAATAGGTTTTGACATAATCACACCTCGTGCAGATTTGACAAAAAA

GAATTCTTACAATTTATTTTTCCTCAAATTGGTGTTAAAATTAAATATAT

GTGACTAGTCAAGTAGGTGATAACAAGTTGCAGCACTTGTATATATGAGT

GATGCAAAGGATTCGTGCAATTTATTTACGAAAATTATATATTGGCATGA

AACACACGAACTGTAACTATATATAGTCACTAACTTGTATACGTACGAAC

TGTAACAATAAATTTTAAAATAAAATATTAATTACAAATATAAAATGGGT

TTTGACAAAATCGATCACACCTCGGGCAGATTTGACAAAAGATAATTCGC

CACGAATTCTTTTTCGTCAATTATTTAACACAACCTTCCTTTTACGAATT

GCACAAATCCACTTTTAAAATACAAGAAAATTTTGTTTTAAAAATTCAGC

CAGCCGACATAGAGGTGTATGCAGGTAAGTTTGGATTGAGTTTCATCATA

CCTATGACTTAAGAATGAGTTGATTTGAGTCATTTGTATACGATTTTAAT

TAAATTATTGGGTTAAAATATTTAAATTTGTATGCTATTTATTAAATCCA

ATATTTATATAAGCTAAAATTCTTATTAATTAGAATACTGAAAACATTAC

TTATAAATTAAATATTGTCAGATGCTGCGACTAAGTGAGGTGGTGGAAAG

ATGTCAAGAGTTGAACTCTAATTTTTGAAAGAATAACAATGACACTCGGT

ACTTATTCAACTCTCTTGTTATGCACGAAACATATATTTAATAATAAATT

CACGCGCGTATTTATAAAATTATATGAGAATTTTTTGTATAAAAATTTAA

ACACATAAATTATATTAAATTAAAATGTTATGGTAATTTTAAAATATGAA

TGATAAAAATGATTCAATTATTATACTTTAATTTTTAAATAAAAAATTGATT

TTTATAATATTTAAAGTTTATAAATAATATTTTGAATAATTTTACATATA

AATTAATTAAATTAAATGCAAAAAACTGAAATTAAATATTTCTTAAAACT

AATTAATTATTATATGAATCACTTTATATTAGTAATTGCGAGCTGCTTGT

CTCTTCTCTCCCAACGGCTCCCGCCATTCAAAGTTTGGAGATAATTAAAA

GCAATAAAGTAGCACTGCATTCGTTACCTCTCTTGGTAGAGACTATAGAA

GTAGAAGGAAGCTCAAGGGTTTTTATTTTAAAAAATATATAAAAAATGAA

TTTAATAATTTTTTTAAATTAAAAAATAATAGGAGCAAAGAGAAGTTGGG

TTCCCTAACCCCGACTTCTCTCTGCAAGCTAAAAGGAGTGTTGTTTAGG

AAACAATTTTGAGGCAGGTGTATTTTGAAAAAAATGAGGAGAGAGCAAGT

GTAGTGGAGTAAAAAAATCCTATAAGATTTTGTTTGATACTAAAAGAAA

AAAATAATTGTGATGAGAAAAAATAAGTTAGAGGATAAATATCTTCAACA

CTTAAACAAACAAATAAAAAAGTTTTTCTAGAAAGTTCACTTAAATCTAT

TTTCACTATTGATAAAAAATTTATACCTGTTGATTTAAAATAAAATTATAT

TTTATAAAAATTATATTTATTAAATATGATAGGAGAAAAATATTTTTTAC

ATATAGTAAAATATTTTCATTTGCTGGACTTAAATTTTCTTTATCTCTCA

TTTTAGTATTGTTGTTTGAGATGATCTCACTAAATATATTTTACTTGACT

AATAATAAAAATTTTATATAGATAAGATTCAAAGGATAATCACCAACCAA

AAATTTTTATGGAAGTATTTATCAAATAATTACAATAGATATATAACATA

AAAAAAGAGTTGAATTGAATAATAATTTTTCATGCCAAATTACTTTAATC

-continued

ACTCTATATTATTATTATTATTATCATTATTATAACATCTTCACAATATT

CTTTATTTTATTAGTATCTATTATTTATTTTATTAATTTTATTTAATAAA

AAATCACAAACTTTTCTTTTTGCACACATCTTTAACGTACATATAAAGAT

ATTCAAATCTTGAATTCATTAATATTATGTTTTAGGGATCAATTAGCAT

GTGTCCTTTCTTTAATTCTTTCTCTTTTAATTTGTTCAACATTTTTTTTG

TCTTAATAATTTTTTAATCTCATTTTTTTATTTTCCTCCTAACAAAATTT

ATTCTATATATAAGAATTAATAAAAATTTAAATCTTTTACCACTTGATTA

AAAAACATAATCATTATCAATTATTTTAAATTTATAAAATCATGATTCAG

TATTAGATCTTTATAAAATACCATATCTCTATGACAATTTTAATGATTAG

GTTGAAATATAAACTAACACGAATTTAAGTAAATATTTCACTATTTACTT

TCACATTGAAAAATTGATTTTAAATTTTAACTTTAGAAAAAAAATTCTAA

GTTGAGGATCTTTACATAACTTTTGGATTTAACAAAAAAATTCATTTCAA

TTTTACTATTAACTTATTTTTTAAATAAAAATATCCAAAACACATGTGCA

AACTGCTTCAATACAACTTGTCTCACAGCATCAAAGCACAGGAACATAAT

TATGCACAGTACCCTTGCAGCCATCCACACATATCACCAAGAAAAAAACA

CACACCACTGCTCCACACGGTTTGGAAAGCGAGAAAGCTGGCCATCACTA

ACTTTAATTATAGCATTTTAGAAATATAATCCATTTTTTTAAAATTAACG

GTAGAAATATCATCACTCTTTAAATCTCTTGAGTCTTTAGTTTAGAGGAG

CTAAATTTAAAATAGAAATATCAAGAAAGCAACATGTGGGGATCAAAAGT

AAAGAGACTCCCAACGTGAGAAGTCACCCACCACCAATTCCCTTGCCTTT

TGTCTTGCACAGCAGAACGAGTGAAGGTGAAGAGAGTTGACTTAAGCCAA

ATCTCATCACATCAGTTCATAGCAACCAATTCCCTTGCCTTTGTCTTTCT

ACTCTGATCATCTTTTGTTCTTGAGATAATGGCAGCAGCACTGGTCGGTG

GTGCCTTCCTCTCTGCTTTTCTTGATGTGGTTTTCGACAGGCTGGCTTCA

CCTGAGTTTGTTGACTTGATCCGTGGAAAGAAGCTTAGCAAGAAGTTGCT

TCAAAAGTTGGAGACCACTCTCAGAGTGGTTGGAGCTGTGCTTGATGATG

CCGAGAAGAAACAGATCACAAACACCAATGTCAAACACTGGCTCAATGAT

CTCAAACATGCTGTCTATGAAGCCGATGACTTACTCGACCATGTTTTCAC

CAAAGCTGCCACCCAAAACAAGGTAAGAGACTTGTTTTCTCGCTTTTCCG

ATAGGAAGATCGTTAGTAAGTTGGAGGACATAGTTGTCACACTTGAGTCT

CATTTAAAACTCAAGGAGAGTCTTGATTTGAAAGAGAGTGCAGTGGAGAA

CTTGTCATGGAAAGCTCCATCAACATCTCTGGAAGATGGATCTCATATAT

ATGGTAGGGAGAAAGATAAGGAGGCCATAATCAAGTTGTTGTCGGAGGAT

AACAGTGACGGTAGAGAAGTGTCTGTGGTTCCTATTGTGGGCATGGGTGG

GGTTGGAAAAACTACTTTGGCCCAATTGGTGTACAAACGATGAGAATTTG

AAACAGATATTTGATTTTGATTTTAAGGCATGGGTTTGTGTTTCTCAAGA

ATTTGATGTTCTCAAGGTCACAAAAACTATAATAGAGGCGGTGACTGGAA

AGGCTTGTAAATTGAATGATCTGAATCTACTTCATCTTGAATTGATGGAC

AAGCTGAAAGATAAAAAATTCTTAATTGTTTTGGATGATGTTTGGACAGA

GGATTATGTTGATTGGCGTCTTCTTAAGAAACCATTTAACCGTGGGATTA

-continued

TTAGGAGAAGTAAAATTCTTCTAACAACCCGCAGTGAAAAAACAGCATCT

GTAGTCCAAACTGTTCACACCTATCATCTAAACCAATTGTCGAATGAAGA

TTGTTGGTCAGTGTTTGCGAACCATGCATGTCTTTCCACGGAATCTAACG

AGAACACAGCAACACTAGAAAAAATTGGAAAGGAGATTGTTAAAAAGTGC

AACGGACTGCCTTTAGCAGCAGAGTCGCTTGGAGGCATGTTGAGAAGAAA

GCATGACATTGGTGATTGGAATAATATTCTCAATAGTGACATTTGGGAAC

TTTCTGAAAGTGAGTGTAAAGTTATTCCAGCACTGAGACTTAGTTATCAT

TATCTCCCTCCACATTTAAAACGATGCTTTGTTTATTGTTCGTTGTATCC

ACAAGATTACGAATTTGAAAAAAATGAATTAATCTTGTTGTGGATGGCTG

AAGATCTTTTGAAGAAACCAAGGAAAGGTAGGACTTTAGAAGAGGTTGGT

CATGAGTATTTTGATGATTTGGTTTCGAGATCGTTTTTCCAACGTTCAAG

AACAAGTAGTTGGCCTCATCGCAAATGTTTTGTGATGCATGACCTCATGC

ATGATCTAGCCACATCACTCGGTGGAGATTTTTATTTTAGATCAGAAGAA

CTTGGGAAAGAAACAAAGATCAATACCAAGACTCGTCATTTGTCATTTGC

CAAATTCAATTCTTCAGTCTTGGACAACTTTGATGTTATTGGTAGAGCAA

AATTTCTGAGAACCTTCTTGTCCATTATCAATTTTGAAGCTGCTCCATTC

AACAATGAGGAGGCACAATGTATCATAATGTCGAAGCTTATGTACTTGAG

AGTTTTATCATTTTGTGACTTCCAAAGTCTGGATTCTTTGCCTGATTCAA

TAGGTAAATTGATCCATCTGCGCTATTTAGATCTCTCTTTTTCAAGAATA

GAAACACTGCCAAAGTCATTGTGTAATTTGTACAATCTGCAAACTTTGAA

GTTGTGTAGTTGCAGAAAGCTGACTAAGTTGCCCAGTGACATGCGCAATC

TTGTTAACTTGCGTCATCTTGGTATTGCTTATACTCCTATAAAAGAGATG

CCGAGAGGAATGGGTAAATTAAATCATTTACAACATCTGGATTTCTTTGT

TGTGGGCAAGCACGAAGAGAATGGAATCAAAGAATTGGGAGGACTTTCAA

ATCTTCGTGGTCAGCTTGAAATTAGGAAGTTGGAGAATGTTTCCCAAAGT

GATGAAGCGTTGGAGGCAAGGATGATGGATAAAAAACACATTAATAGTTT

ACAGTTGGAATGGTCTGGATGTAACAACAACAGTACCAACTTCCAACTTG

AAATAGATGTGCTTTGCAAGTTACAGCCTCACTTTAACATTGAATCGTTG

GAAATAAAAGGTTATGAAGGAACCAGATTTCCAGATTGGATGGGAAATTC

TTCCTACTGCAATATGATTAGTCTAAAATTGCGTGATTGTCACAACTGTA

GTATGCTTCCTTCACTTGGACAACTACCTTCTCTCAAGGACCTTGGAATT

GCACGATTGAATAGGCTGAAGACTATTGATGCAGGTTTCTACAAGAATGA

AGAATGTCGTTCTGGGACGTCCTTTCCCTCCCTTGAATCTCTGTCCATTG

ATGACATGCCTTGTTGGGAGGTGTGGAGTTCCTTCGATTCAGAAGCTTTT

CCTCTCCTTAACAGTCTTGAAATACGTGACTGCCCCAAACCTAGAGGGAA

GTTTGCCGAATCACCTTCCTGCTCTGACAAAACTTGTGATTAGAAATTGC

GAGCTGCTTGTCTCTTCTCTCCCAACGGCTCCCGCCATTCAAAGTTTGGA

GATATGTAAAAGCAATAAAGTAGCACTGCATGCGTTTCCTCTCTTGGTAG

AAACTATAGAAGTAGAAGGAAGCCCAATGGTGGAGTCCGTGATCGAGGCC

ATCACTAACATCCAACCAACTTGTCTCCGGTCTTTAACATTAAGGGATTG

-continued

TTCGTCAGCCGTGTCATTTCCGGGTGGTCGTTTACCTGAATCACTGAAGA
GTCTGAGTATCAAGGATCTTAAAAAACTGGAATTCCCGACGCAACACAAA
CATGAGTTACTGGAAACACTGTCAATAGAAAGCAGTTGTGATTCACTCAC
ATCTCTTCCATTGGTTACCTTTCCAAATCTCAGATATCTCAGCATCGAAA
AGTGTGAAAATATGGAATATCTTTTGGTTTCAGGGGCAGAGTCATTTAAG
AGTCTGTGTTATTTGTTAATTTACAAATGCCCCAACTTTGTATCATTCTG
GAGAGAAGGATTGCCTGCGCCCAACTTGATTACTTTCAGTGTTTGGGGCT
CTGACAAGTTGAAGTCGTTGCCTGATGAGATGAGTACTCTTCTCCCAAAG
TTAGAAGATCTCACCATATCCAACTGCCCAGAAATTGAGTCCTTTCCAAA
ACGGGGTATGCCACCTAACCTGAGAAGAGTTGAGATTGTCAATTGTGAGA
AACTACTGAGCGGCCTAGCATGGCCATCCATGGGCATGCTTACTCATCTC
AATGTTGGGGGTCCATGTGATGGCATCAAGTCCTTCCCTAAAGAGGGTTT
GCTGCCTCCCTCCCTTACGTCTCTGTCTCTATATGACTTGTCAAATCTGG
AGATGTTGGACTGCACGGGGCTTCTCCATCTCACATCCCTGCAACAATTA
CAAATTTTTGGATGTCCAAAGCTGGAGAATATGGCTGGAGAAAGTCTTCC
TTTCTCTCTAATAAAATTAACCATGGTGGAATGTCCTTTGCTGGAAAAAC
GATGCCGCATGAAGCACCCTCAAATTTGGCCTAAAGTTTCCCACATCCCT
GGCATTAAGGTTGGCAATAGATGGATTTAGCCACCAAGGAGGACCAACAG
GTATCTTCTAAGTCTAACCAACTAGAAAACTATTTCTGTCAAGGATATGT
TTCATTTCATGTCTTTCTACTTTTACGTTTTACTAAATCCAATTCATTCT
GAAATGGAAATTGACCTTGTATATATGTTACTGAATCTACAGAGAATCAA
CAAATCATCAAAGGCAACGTGGAAATTGACCTTGTATATATGTTTCGAAG
AAGTAACGATACAGGTACTAAGTAACAACATTGACAAATACTTAAATATA
ATGATTCTCCGGAAAAATGTTACACATCAGTGTTGTTATATTCTAACTTA
ATTTCTCCTTAAGATTATTGAGGCCAGAGTGAAAATGACCGTGGGAAACT
TATTTTTGTTTTTCAGATATGGTTGATTGGCCCGGAGAAACTGTACCTAC
CCATGAATCTAAGTTCAAATTTGAACTAGTGCTAAATGTAACTTTTAATT
TAATTGATGTCAAATTGACACTTTCTCAATAGCTGAATTTTTATTTGTGA
GGTTTTTCGTTGGGTACAATGTGAAGGATGAAAAGGTGTACCAAGTGAAC
TTTAGAAGGATTGGATGATTTCAGCTTATCTCTTATTCCCTGTCCTATAA
ATTAATAATGGTATGATTATTCTAAAAATATGATAGATATGTAGATAAGT
AAGAATTGATAAAAGCATAATAAATATACAATTGCAATTCGGTAAACTGA
AGAACATACATACTTCTTAGACATTGCTAAAAACAAAATCAAAAAAATTGT
AGATCATTTTTTTCCTATTGTTCACAAATAAGAATGGTACTATCAATGAT
CAATCTCATTTCTTTCTTGAAATTATCTATAAACAAAACAATTTTCATAT
TGGTTCATCAAGAAACAATACTTTTTATATTTCTATATTATACTTACTTC
TATGTTACATGTCACTATATTTGATTATCATAATTTTTTTTTAAAGAATT
GGTCACTTCACATATATGTATCAGATATATTGGTATCAGATATAGATGCA
TGAAGCAAATTAAAGTATCAGTACTTTGTAGCAAAACACATTCTTCAAAT
CATGACATGAGGTAAAAAAAAATAAGATGATATTTTTGTAAGTATTGGAA

-continued

AAAAAAAGAGTAAAGCTTCTGAAATCAAAGAGACACTAATTTTCCACAAC
ATCCTTCAATTGGGCCCAAGCTTCCTTTCCTATGGACAAATAACTGGTTG
TTAGTGCCAGCCTTTTCTTTTTACCAGTTTTCCATTGATGGTTAAAAGCT
ATTATGAACCTGTCACTCCTTAAAATTTCCACCAAAGTTTGGTAAATAAA
TATATAGGAGAGTGAATAATACAAGTCTTGCATTCTATCTCTAAGTTATT
AGGTATATGAAACAGGTATGGGTATTTGGTTTTAGAAGGTATGTGGTTCA
TCACTATTTATATTATTACTACAAGAACCAGGTAAACTTTATTATGGTAC
AGTAAGTTTGGTGTGAGTTGTAACTACGTTATATCCATCTCACTTAGCAC
GATAATTAAATTTAAAAGCAAAAAGATAAGAAAAAGGCCAATCTAACAAT
TGTTACCTCTCTTGCATGACAAAATCAGAAACAAAAGTCCCACTCTTTCC
TCCATGGTGCCTGTAATTAACAAGCACTTCAAAAACCAATGTTAATTAAT
TAATTTCCATAAAAAAAAAAAGGCAAAAGCCAATGAAATTTAAGGGGTAC
AACAAAGATTTGTAGAACGATCATTAATATTAGTGCAACGCACCATGATG
AAGTGCATGACATAATAATAATGTGGAACCAATCATGATAAGAACAGAAA
ATAAATCAATGCAATTGCATGATCAGAAAATAACGAGGCGATATATCATG
TTCCTATTGATCAGACAATAGGACAACGTGTTAAAGAAATGTGTCAAGTG
CAACAATGAGGGAACGGAGAAGAGAAGGATGATAAAGAATGTGGTTATGA
CTTCTACAAAGTCCAATTATTTACTTTTTTAATTTTTTTATATTTTCCTTT
TCACTTTCCTAATAGTTGTCGGATTAAAAGGAGTTTATGGAGTAGATTAG
ATTGGTTTTGAAAAAGAGAAATATCATCTGATACAATTTTTAGTTTTCTT
AATTTATTGTTCAATTGATGTAGTTTAAAAAGTTGCACTAACTGAAGTGG
AAAAGGAACATAGGTTGGCATAATGGAATGGATAGCATTTGATCTTTAAT
AAATTTTTGCTTTGTGATAGGTTCCTAATATTTAAAAAGTTTTGTTTGAA
ATACTTATCATTAGTCAAAATCCGTTATTTGCTCACACGATCGTTAACCA
GCCACACAGACATGTCATGTGTGATTTTTGTCTGACTGAGATTAGGACTA
ATGATAAGAAACTATAGTCAAAATCCTTTGGACATCAAAGAATCATTCTT
CAGCAAATAACGGATTTTGACTAATGATAAGAAACTATAGTCAAAATCCC
TTGGGCATCAAAAAATCACTCTTCAGCATTCCTCTACGTTTTCACACAAC
CCACTATAGTTTCTTCTATACCTTTCTTATGGATTTGTCACTATGACTTC
GTCACTCGTAAAGATCCAAGGTGAAGAGGTCCTCACCAACGATTTTTAGG
ACCTTGCAATCAATTTTGCATTTTCAAATCAAACCAAGCCAATTCCCAAC
TCAAGAAATTCACATGGATAAGGTTTCTAAGAGAACACATCAAAATAGTT
TCATGGGTAGAAGAAGGTCAACAAAACCTTACCCTAAAATGTGATTCCGC
TCGGTCCATTGAATAGAGCACGAAAAAATGAGTGGGATAGCGATGTCTGA
ACTTGTCGTCGACCTTTCATAGTTGCGAGCTCTTTTTGCAAACCCTTGCT
TTCATGGTTGTCTCTTCTTGTTCTCCCTTCTTAAAGGTCACCACCAACCC
AGCCATCAGCCACCACTGGTGCTGCCAGTCGTGCCACTGCTCGTGCCAGC
GCCAGCTACCACCAGTAACTTCCTTCAACTCTCAAACCTCACTTCTCTCC
CAGTCTCTCTCTCACACTTGGCCCTCCAACCCACTTGTGTGTCGTAGGTG
AAGAGAAGGAAATGATGAAAACAAAGAGGAGGGTTTTCTTTGGGGAAGGG

-continued

GGGTCCATGAGTGATTTTTGAGAGAAGGAGATTTGTTGTTGCCATGGGGA
GCCATGGTTCAAGAGAAGAAAAAAAGAAAATGGGTTAGAATTATTGTTGT
GTTGCTGCCATGGGGTTTCAAGGGAGGTTTGGGGGGTTTTGGAGACATAA
TAGCGGTGGTGTGGAGCTAGTGGAGGAGTTGGTTGAGGACTGGTGGGGGT
GGTTTGGAGGATTCGGGGACTTAATGATGTCGTTTTTTTACTTTTTTCTA
TAAAAAAATAAAAAATCTTACGTGATCGGTTAACGATCACATATGAAGAT
AATGGATTTCGACTAACGGTAGGAACTTCGGACAAAGCTTTTTAAATATT
AGGGACCCATCATAAAGCAAAAATTTATTAGGGACCAAATGTAAAAAATG
AGTATTTATCAGAGACCAAAAATATATTTAAACCATTACCTAATTGCAAC
TCACTATGTGATAAGTTTGTTGACTTTTAAAATAATTATTTTAAAGTAAT
TCAAACAATAATTTATAATAGTGTAAAATCATTTTACATCATCAATACAT
AAGTATTAAACTCGATATCTCTCTCTATATATATTTTCTGTTCGAGATTG
ATTGAAATTATCTTATTTGCTTAACATATTAAAATGCGTCATTTTTAATG
ATATTATTGGTCTATAGTTTTTATGTAATACATTTAATAATGTTTAGAAA
TATTTGTATATAAATAACTTTTATCTATTATTTCACCAGAGCCTATGAAA
TGTAAGCACAGGTTTGTTAATGAGTAGCACAACATGGACAGTTTGTCAAA
GGCCCAATAGCATCTTTAATGGGATTCTTGAACTCAAGAACTCTATCCAC
TAGATCTACTATTATTCTTATTAAGAGTTTTTTAAGATGGAGATTGGGTT
CTAGGAAAAGAACTCCTATTTTTTCAAAAATATTATTTTTTTCTTGTGCTA
GTAAAATCTAATAATCCGAATTGGATTCTACTATTAGAATAAAAAATGAT
AGAAGTTCGTGCATCCTATATAACATCATGGGACTCACAAAAAATAATCC
AAGAACCTAAAATGGATTCTTTGACCAAAAATGTTCTAAGAATCTCAATA
TTTTCCCACTTAAGAAATATAACTATCAAATCAATATAATATGAAATGAG
TTCAATCTTTATTGATTCACTTGACGCAAGCTATATGCACAACTGACATA
ATAGATTTTAATTCTAAATAACATGCAATAAAAATATAACAAACCTGTTC
CGGAAAAAGCCTCCTCAAAAAGAAGCACATTCGGTCCCCCCACAATTTTT
ACAAGTCGGGGTCTTTATGCTGCATCAAAATATTCCATCATATCCGCAAA
TGTTTCGTGCTATTAAGTTTATGTTAGTTGTCCCTTCATGATGCATCACC
AGCATATCATAAACAATCAGTTAATCCCTTATTCTGCCGAAATAGTCGGA
TTATCGTCAATCCCCCTTAAGGTGGTCGTTTGATCCCGCTTGGCAAGGCC
CAACTTTGAAAGTGAATTGACCTAAGCCTCTTTTATGGGCTTGATGCGTG
ATAGAAGATCGGAACATAATCCAATACATTCCAATCTGAACCAAAACAAA
ACCTAAAACCAAACTACTAACTGATCTATAATTTTTTATACATCATAAAA
CTAAAAAAACAAAGCAAACTAAGCACATAATCTTACAATCCCTTCTGAAT
TTACTAAAAGAGACACAGATAGTTGAGGTGGGAAATGTTGCCAAACCAGA
AATGAATTATCACGCTCCAAATTAACTTTGGAAGCCAACCTGCACATACG
TGTCTTCATGAAGAGTATGCTGAAGCTGGATCCTCCAATCTTGCTCCAGC
AGTGAGCTGATTAAGTTGATGAGGGTAGCATACGTGAGGATGAAACTTGT
TGGTTAATTACTTAATTTCTTCCTAGGACGAGTCTAAGAATCAGACTCAA
ACTAATAGAAGCCTAGATTCAAGGCATGACAGAGACCATAAAAGATGGCA

-continued

TGGAGTTCAGCCTTGAGATTGGTAGACACTCCACACGATCTTGATTTCAT
ATTTTTTTTCTTAAAATAACTACATACATATTAAGTAGCATGGTTTTAAA
TTATGATTGTGATTACTTTAAGGTGAGTCATAAAATCTTTTTATATATTG
CAGCTAATCACTGGAAAGTATGGCTGATGTGGTTACAATTAGGAGTCTTC
TTAAAGCATTAATATTTTTTAACTTAACAAATATAATTAAAGAGAAGTAA
CTAATAAGATAATGATCTAAAATTCTTGTATTGATTGGAAATAGCGTAAA
AAGATGTTTCAAATATAATGATACAAACTCTTTAAATGCAAATGGTTACA
TGCACAAAGCACGTGTATATATATGTATTCATACATACATACATATATAT
ATATATATATATATATATATATATATATATATATATATATATATATATAT
ATATATATATATATATATATATATATATATATATATATATATATATATAT
ATATATATATATATATATATATATATATATATATATATATATATATATAT
ATATATATATATATATATATATATATATATTTGAATATATCTACGTACATTC
ATATATGTATGTATATGCAAACATATATACATCTGGATAGAGAGAGGATC
AGAATAGCAGGACAAAGACAAACTTGTATTTGTTGCTTCCATACTAGAAT
TGCATTTTCTTATATCAACTGTGTGGAAGGGAAATTTATTAACAGCGCTA
AGTATTCTCCTAACCTTAAGCAGGATCTCCTTCTGGTCTCTTGCCATCTG
AGCTTGCATGTCAATGATGAAAAACCTGACAAGCGAGTCCGCAAGTGCCT
CAAGTTGTTCCTGGTAACCAAGCTTTGTCACATTGACCAAAAAAACCAAG
GTGACATTGACCAAAAAATAGTCCTGACAAGATGTTGGTAAAAAAATATA
ATCGGTTAATATCGATCACAAACATCATTGACTAAGGTTGACAAAAAAAA
TTTTAACCGACATTGATAAAAAAATAACTTCGACCAATGTCGATCAAAAG
AAACATAACCGATTTCGGCCAACAGAAATATTTTATATGATAGCCTTTAG
TTGCAAAAAGTGTGAACCAGGGGGTATTTTGACAGCCGTAAAACATATCT
CATGGCAGTGGTTGTTATATAAGGCAAAAAACCATGAACTTTCTTCTCTT
GCTGGTGTTTGGAGCCACTTCAAATGTGATTGATGTTAGAGAAGTTAACA
GTGGCATTTTTTAGGACTGAAAGTTAACTTAGGAGAAACCATTTTTTATG
TATGTAATACGGTAACACATGTACCTCTTGCACAGATTGGGGAGAAATTG
CAACTTTTTTTTTACATTTTGCCTTAAAAAAAGTGTTCATATTTATAAAA
ATAATTTTCTATTTAACTTGGATATTTTTTCTTATACTACTACACTAAGG
TATATACAACCTAATTAAGGCGTGTTTCTTAATTTGGAGACTGGTGCTTG
ATTGATTGACTACCAACGAAGGATAATCTAAAAAGGAGAAACACCATTTA
TAATCCTCATGAGTGCTTATGTCCCTTTTGCCTTGAGGTAGATGAGTCGG
CATCTCACTGTTTCTTCTCATGTCATAAAATTCTTGGTACTAATTTGGAG
GCAATGTTACTCTTGGCTGCTGGCTGCATGTAAATGTGGTGTTGCCACAA
TGACCAGAATCACATTTTTGGCAAGATTCTGTATTCGTAAGTTCAAATTA
AGAAGGAGGCAGATGTATGGAGGGCGGTGTGGGCATCAGAAATTTTGGGG
TGTATGGAATGCTAGGAATGAGTGTATGCTAAGGAATTAATGGCTCTTTC
AATGCTGAGAAAATTACGCAGAATATATTATTCTTTGCACGATCGTGGAT
TAATAAAAGCCAGAGTCCCTAATTTTAATTATTGTTTTACTTAATGATAT
ATGGCACCTGGAGCTTGTTTCATGAAGAGACAATTTTGAATGAAATGTGA

-continued

AGTTAATTTGATTCGGTGGTAGCTGCTCTTCGAGTGGGATCATCCCAAAT

GCAACCGATGTTTATGTGCACGATGGTGGGGGCTGGTTAGTGATGCGCAT

CAATGTTGCATGGCTTTAGACATGATTTTAAATTGCAATTATGATTGCGT

TGCTTGCAACGAACCTAAAAATCTTACATTGTGGATAATTATGGAAAAAT

ACAAACTGATGTGATCATAATTATAATTGTGATGTGATTACAGAGTCAAA

ATACATTAGCGTTATGACTGCAATTATGGTTGCTGACTACAATTTAAAAC

CATGACTTTGGGTGTAATGGTCCATGTTCGATGCTAGCTATCTTTGTCGA

GATAGAAATATAATCTAACCATGGAATTTGCTTTCTTTCTACTGTCACTG

GTGTATATGTTTTTGGATCTTAGGTACTTTTGGTACCATTTAATACAAAT

CATTTTGTTGGAAAAAAAACTACGGTAGCCTACATGCAATATACAAAATA

AAATTGAATTACTATATATTATCATAAATAGTAGAGTATAAGAAGTAAAG

AAAATTCTAAAGATAACATGAATTTAAAAACATATGAAACTAATATATAT

ATATATATATATATATATATATAATAATAATAATAATAAGAGATTGTTTT

AACTATATATATAACATATTTAATTAGCTTAATAGAAATGCGAAAGTACA

ATAAAAAAGCAAAAACATAATAGGCGTGACAAATCGGTTGCTAATATACA

ATAAAGACAACAAAGTTTGAAACTAAAACCTTATCCAGACTATCCAAATA

ACCCTAATTAATCATGCAAAAATTAGAACAGAAGAAATTTAATAACTATA

GCAACAGTAACAGCAGCAGCTATAGCTAATGCCGCGATCACCGAATCGGA

AAACTTTTCATCATTGAAGTATTCTATTTCACTAACCCTAAGCAAGATCT

CAAGTTGATCGCGTGCAATAAGAGCTAGCATTTCAATATTGAAAAACCTC

TCAATTGAGTCTGCAAGATCTTTAATTTTAGTTATCCACGGTAAGAATTA

TTAGCCACAAAATTGTATTTCCCTATTTTTGAACACTTGTAAACAACCTC

TTTGCTCTTCCTCAATAGTTGTATCAGTGGCTCAAGTTCCTGCTGTGAAC

GGCCCAACATATTCCTGTACTTACCTATCTCCTGCCATGTTTACCGCTAC

ATATTTTCTAGAATGTTATTTGAATTTCATTAAAAATCATAAGAAGCAAG

TTTGAATTTTTCAGTGAAATTTTTACTTAGGTTTAGTTAGAAAACCCTAT

TTAAAAGCTATATTGTTTTGCTTATCGAAACAAAACCAATTAGTTCGGTT

TGAATTCTTAGTTAATAAATCAATTTTATATGATTTTTTATACAAAATAT

TAAACTCAATTTACTAAATAAGATTTATATCAAATTCATGAAGGTAAAAG

TAATATTTTTATCTTTTAATGTAAGGCTTGGTTTCACTTTTGTCCTTTAA

CTTTTTTTTTATTTGATTTATTTCAGTTATCATTTAATATTTATGGGTTCT

TCCTTAAGGAATCTTGATTTTCCTATAGTTTTAATTGTTCTTCGGTTATT

TATTCCGAAATTGAGAGGGGATCATCACCTCCAAAGATTTCCTCGCTCCC

ATTAACAAAAATGTCTAAACAATTACCTTCCTTCTAAAAAATTTGTAAAG

TACCTCCACTAATTAAACTCAACATATTCTCCCATACTTCATTTTCTTTG

AAAACAATGTTGTCTAATTCAAGACGCTTCGATATAAAATATTTAGTCGC

TAGAACGAGAGAAAAAAAATTGAATAAAAAGAAGGGATTTTTTTTTTCTT

CTTAACGTACTTCATGCTACTTATTTGCTGGCAATCATTATTAATATATA

TTATCTTATATGAGACAATTTTGAACATTTAAATGTTAATTTTGTAAGTA

TCTTGGTAGTATCCTTTTCTGATAAGGAATAGATATTATTTTGAGATTAT

-continued

ATTATGATGATGAATTGTCTCATAAAAACACGAGGCAAGCACTTGAAAGG

AACAAATTCTCTAATTTCTTAGTGGGTAGTGGGAGAGAGGAAGTAAACTT

GCTTCAATAGGCAAATGACGCATGACGCACTCTTTATAGGAGAAGCAACA

CTTTCTAAGGTGCTTACCATAAAAAGCATTTTGAGAGGCTTTGAACTTGT

CTCGGGCCTCAAAATGAATTTCCATCAAAGCTTTTGTGGTGCCTTGGGAG

TGGATATTGATACCTTGATGAATTATGCAAGCTTGCTTATTTACTTGAGA

CAGACTATATATGCACAACTGACAAAATAGACTTTAATTCTAATAGCAAT

AAAAAGATATATAATAAACCTGTTTGAAAACGGAGGCTACTTCAATCTAG

TACGGTAGTTGACTTACTAAGTACGAAACAACAAATTAATGAGACTGCTG

ACTACTGATTTCATAGAAAGATTTAGGAAGATGAGGAGTAAGAAATGTAT

GGTAAAGCTTCTAGGAGTAGAATATGTTACTATGTCTTAAAGTAAAAAAA

TATTTATGTTTAAAAGATGAATTATGATTCATAATTATTTTAATTAAATA

TAAATAATAAAAGTTATATATAATATATTATTGGATCATAATTTATAATT

TTATGTTTGTATTTTCAGTCAATACATTTATAAAACAATTTAGCATAACA

TTTATGAACTAAATTTAAAACCTTTATTTAATATTTTAAGATTCTTTCAT

TAGAAACAAGTTCCGGTATAGGAGTTGGTATCCTTTCAAATGATATAAAG

CAATAGATTTAAATTTTATATTCTATTTTATTGTGTCAAAATAATGTATT

AAATTCTTTGGTAAGAGACACTATAATTTTAAGTTATTAAGTTGATAATT

AATTAAACATGATTTTAAATACTTACATATTTATTCACTTATAACTATAA

AGATTTAGTAAGAGCATAAATAAAAAATGTTGTTATAATATATAATTTTA

AATTTAATATAATAAAAATGTGTTAGCAAAATAGAAATATAAACATAAAG

CGTGACAACACATGTTTTTAGTTAATAATAATAATAATATTAATTACAAA

TATTAAATAGGTTTTGACAAAATCATACCTGGCGCAAATATGCAGTTTAG

TGACGGAATTATTTGTGATTCATGCAATACAATTTGTACCAATCATCATC

ATCATCATAATCTCTTTTTCGTTTTATTTATCAATGTTGCTACTTAGTAC

GAAAATTATTTGCACAAAATACAAACAGAATGATGCTATCTGTTATGAAA

AGTAAATCCACACAGAATTACACGAAACATAGAATGGACGGTTATGATTT

TATAAAATGAATATCGATTAAATTTAAATGTTATGGTAATTTTAAAATAT

GAATGATAAAATGATTCAATTATTATACTTTAGTTTGTAAATAAAAATTG

ATTTTTATAATATTTAAAGTTTATAAATAATATTTTGAATAATTTTAAAA

ATAAATTAATTAAATTAAATGCAAAAAACTGAAATTAAATATTGCTTAAA

ACTAATTAATTATTATTATATCATCTGCTCCATTATAATTGTTGTGTAAA

AAATAATAATTCTAAAATAATTTTTATTTTTATTTTTTAATGTAAAATTA

ATTATGTTTTTTTACTTATATTTCTTATATATGAATGATGAACTACAAAA

TTTAAAAATAAATTATTGATGATATAAAGTTAATTTTATAAAATTATTTT

TTATTTTTTTATTTATATAAAATAATGTATGATGATAATTATTTTCAGAA

GAAAAGCAACACTTTTCTAAGATAAATTGTTATAGATGTTTAATATTATA

TTTTGCTTGTAAGACAAAAACATACTAACTACTAAATTATCTAATTTATG

TATATTTTTAGTCCTTTGCATAATCGGGCGATAACTTATCATATGAAAGA

ATACTGATGATGATAAATACTTTTTGAAGAATAATAATTTTTATGAAATA

-continued

TTTGAATTAGTTTTACATTAAGAGTTTCTAATGATCTTAAAATGATTAAA
TGTATTATATTATATTTAGTAATATACTTAAAAATTTAAATATTGTTGTA
ATTTTAAAATATGAAAGGATAAAATAATTGAATTATTTTACAATGGTATT
TCAAACAAAAATAAATAGTTATACTTTTTTTTTATAATACTAGTATATGT
ATAAAATAGAAGAAGATAGATAAATAATACAAGTTATATCCAATTACTAC
AAGTACGCACCGATCAATTTCAATAAAAAAAAAAAACAAGGTGTGAGTGA
AGTCAACAATTAAGATAGAAATGAAGTTGGAAGAATCATCGATTTTAAGA
TTGCATTATATGCTAATAATTGGGCTGACTATATATACCCAACAATTAAT
GTTGTTATCGTTGTTGTGCTTGTCTAGTGAATGATGGCAGATGTTGTATT
TCAAGGTATGGGAACTGCGTGGCAATTTCTGAACGTGATTATGGTCATAA
AAGACAAAGTTACGTTCAAAACAGCATTGGAAAACCTCCAATCCATTCTA
ATACGCAGCTTGTTTCTGATTGTTCCAAAGTCCACAGCTTAAATTTTGTG
GCCAGGCATCGTTACAATGTTAAACTAAAGGCATTTACAAAGTCATTTCG
GAATATTTACTCCACGGTCATGTTAGCTCAGATTGCAAGAGATCAAAAAG
AGAACCGTAGGAGTCAAATACTACTTGCCTACAATAATCCTGCTCAGTCT
CATAAGATTCTAAGTATTGTTGATATATATTAATATTAAGGGTCTATCTG
GATAAATGTATTTAGAAGTACTACTAAAAAAATCCATCTCAAAGCAGAAA
ACGCCCTTATTAGCTTCACAGCAAAGACAGAAATCCACGTCAAAAACATT
AACAACGTGTTTTCAATTGCCTCCCCAGGGTCGAAGCACGTTTTCTCAAC
AACCCTAAGCAATGTCTCCTCTGATCTCTTGCCATCTGAGCTTGCATGTC
GATGGCAAATAGTTTCCCGAGCTCGTCGAAAAACCGGTCCAGTTTGTCCT
TGTAACAAGCCCTAGTCACAAAGTGTAGCCACCGGATTTTTGAACACTCG
AAAACAAGCTGTGTCCCCTCCTCCATCTTTCTGATAAACGATTGGAGTTC
CTCCTTCGGAAGCTGCAACTCGTTGTTTTTCTGTTCTATCTCCTTGATCA
CCGGAGATATAGCTACTAGAGTGGATATTGGAGGTGCACCAAAGATGATT
TGAAGCAAACCGTTTTGTTTTTAAGTTCCAAAACGGTTCCCAGCAACTCG
TTGAACACAGCTCCCACTGTTGCTTCTATTAGTAGTGCCATGATATTCAC
AACAGAAACACGCACCCACAAGGATGAAAACAAGATGAAGAAATAAACCT
CTCTTTATAATATATAGAGTCAGGTTAAACGTAATGTTAAAAAGGAAGTT
TCTTGGAACTCCATTTCTATCCTGTTGACTTTACGAACTTGTAGCTAGGT
ATACTTGTTTGTATTATTTACCGACTTGAACATATTTTAATTATTTATTT
AATTAACTGAATAGTTATAATTTCCTTAATAGATGCGAGATGCCAAATCT
TGTTCCACCCTCCAACCCCAAGGATAATTAATAGTTAAGTGTGAAATAGT
ATGTGTGTGTCTATCTATATATATATTATAAAATTTTTTATACAATTATC
TAATTATAACATATTATTTATGTGAGAAATTTATTAATTTTTTAAATAAT
TCAAATGATAATTTATAATCAGATGACCGTGTCAAATTATTTTATACCAT
CAATGAATAAACATTAATCTCTCTCTCTCTCTCTCTCTCTATATATAT
ATATAAATTCTAATCAAGGTTGGTTGAAATTATCTTACACTAAAACTACC
ATTATTCTTATTCAAGAGTATTTCATGATGAAGGTTGGATTTTAGGAGAA
AAATTCCTAAAAATTCCTTTTTTTTTTTGTGCAAGTAAAATCTAAGAATT

-continued

CAAATTGAATTTTATCATTGGAGCAAAAAATGATAGAAGTTGTTGCATTC
TATATAGCATCATATGACCCATAAAAAATAATCCAAGAATCCAAAAAGGA
TTCTTTAACCAAAGATGCTCTAAGAATCTCAATATTTTCTCACTTAAGAA
ACATAACTATCAAATTAATATACTATGAAACGAGTTTAATCTTTAGTGAT
TTACTTGAGACAAACTATATGCACTACTGGCATAATAGACTTTAATTCTA
AAGAACAATACAAAGACAACAAACATGTTCCGGAAAAAAGCTTCCTCAAA
ATGGAGGCTACTTCAATTTAGAACACTCACGTGAAGTGTATTGTATAACA
TGTCTCCTTAGGTCAGAATGAGAGCTTTTTATTCGTGCTTGAAGCACGCC
CCCTTCAATTTTTACAAGTCGAGGTCTTTATGTTGTATCAAAATGTTCAA
TCATATCCAGCTAATGTTGTCGTGCAATTAACTTTATGATAGTTGTCCCT
TCATGATGACTAACTGTCGTACCATAAACAATTCATTAATCCCTTACTTT
TGCTAGCGAGAAAATTGTTGCTGCAGTCCACTGTAATATCATTTGTTGCA
AAAAATTTTGCAACGATATTTAATGTCACTACCACTCTTAACGCTTTCGC
AACAAAAACTTCTACTATTTGATAACTACGAAAATTAGGCTTATTGATAG
TCAAATTTAACTAAAAATGATTAGAATTTCTTTATTTTTATTATTATTTTT
AATAGAATAATGAGGATTTTAATATCATTTTAATTCTTCTTTCAAGTTTT
TAATTTCTCCTCCTCAGTAATCTAGATTCCATAAGATACTTCTTGAAGTG
CAGCTATGATTTTTTTTTTTTTTGTATTTTACCATTCTTTTCTTAAAATTA
TCATACATAATTATATATGCTATATACTTGTTGTTAGGGAAGAAGATAAA
AGTTGGTTTTCGAGGATCAGGGCCTCCACTGAGAAAAGGATAAGGGAAGG
AACAGTTGTATATTCCATTGATTGATGCTGTTATTACATAATATTATTTA
TACTGATTTCTCAATAATCAAATTTGTCTTTTTGTGCTACAGAATATCAG
CAAATGGTTAAGTTTGTCTACCCCTACAGTACAGTGGCGGATTCAAGATC
CTAAGTCAGTTGGTACAAATTATAAAAAATAAAATCAGTGGGTTCAATTA
TATAAATATAGATGAAATAAAATATAAAAATATAAGATTTTATTTACAAA
TTTGGTGAATTTTAAAAAATGAGGGGATGCAAGTGCACACCCTCAGATGG
CTGTAGGTCCGTCATTGCTTCCAGATATGGTGCACCTGCTTGCAATCCTT
GAGCTAAGTGGGCCTTGTAATTGCTCTCTTGGTCTTGTTTTCTAATTGCA
CCCTTTTCTGTTGCTTGCTTGCTGCATTCTCATCCTCTGTTTCTGCAACT
GGTTCCTTTGCTACGCTATCACTTGTGGTGCCGTTTTTGGCTTTTCCAGT
CTTCCCAAGTTCCCACTGATTCAAATTCCAAAAGTTCTGCAAATAAAATT
GAAGAAGAAGCTAGAGGTGGGAAATACTTAAGTCATTCTCTTGAAAAAGT
TGCAGCAATGATATGCAACAAAATATCACTATACCGAGTCAAGGTAATTA
TTGTGTTCACATGAACATTTCTCCCATGAAAATATATATTTTCTGACTTT
GTAATCTCTTTATAGTATGCATGGAAAAATAATTTTCTGATTTTTTTTCT
CTGTAGTGTTATATATTATTTTTAATCACATTTTCTTATTTATTTAGTTT
GTTTCTGATTTGACATCATGTGAATTTGGAGATTTGGGTTAGAAATATTT
TTGGAATTTTCCTGGTTAGAACTTGATAGGTCCATAATGAAGGTATATAA
AAGGATAGGGAAAAGAGGGAGAGCGGAATAGAAAAAGAAAGGACAAATGG
GCCTCAAAAACAAGACATGCTTGTGTATGACAGCAGAAAGAATCAGCAGT

-continued

ACAAGTTGCACTAGCTGAAGTGGAAAAGGAACATAGGTTGACATAATGGA

ATGGATAGCTTGTAAGGAGAGTGTACGTAGAGGCTGAGAATAAGTTCTTC

CTTAAGAAAGGGAGTGGGTCTGGGTTTGTTTTTTCCTAATTACCATTCTC

AACATCTGGCTTGTATCCGCCACTCCCCTTCTCTCTGAGTTCTATTTTTC

ATACTTGGAAGCCTATTTTTTTTAATATAAATATAAAATTATGGGGATAT

CTACCTGTCAAAACTTAATATAATATATTAGTATCTATTATTTATTTATT

TTATTCATTTTATTTAGTAAAAATCACCCACTTTTCTTTCCGCATACATC

TTTGACATATATGTAAGGACATTGAAATCTTTAATTCATTAATATATGTT

TTTAGGAATAAATTAACATGTGTTCTTTCTTTAATTCTATGCGTATGGGT

TAACCAATATTCAAACTCTAGACCATTTAGTTAAAAAATACAAGTCATTA

CTATTTGTGTCAATCATTATTGGTACACTGCACAAGTTTAAAATCTAGTT

AGATTTGTAAAGAAATGTTATGTTACATTTCAAATGACTTCTGACTTTCT

TTAGTAGCTAAAAAACTTGTTTAACTATTTGATAAACAAGTTTTTTCAAT

AATTTTTAACATTTTTTAAAACGTTACTTAAATTAATATTTTTAAAAATA

CTAGTTTCTAACATTTTATATTTTTTTCTTATTTTATCTTTAATATATAA

ACTTAAATCTTGAATTAGTTAGATACAAGACTATATCCAATCCCACTTAA

CTAACCTCAAGAAATTAGATGTCTTATATAATTATTAAATTTATTTAATA

CACGTCTTTCATTTTGTAATGATAAAAGATTTACTGATAATAATGCATTC

CTTTTATAGTATTAATTATTTTATTTCTATTATGACATTATTTTCTTACT

CTAATTTTTAAATATTTTTACTTCATAATAAATATAAGAAATGTAATATC

AAATATTATATTAAAATTAAAATAATTTTAATACGAATAAAACAATTAAT

CATATTTCTAATTTATGCGTTATGTTTTTAAGCTGAAAAATAAAATTAAC

TGTAAAGATTTGGGTTTAGTTAAATTTATTCGTAATTGACTTTAGAAGGA

GTAAATTGAAATACACTTTTAAATTAATATTTGAGTTTCTCTATCAAAAA

AGGCTATTTGAGTTTTATATTTTTATTCCGACGTCAAATTCTTTGATATG

TATAGACTATATTTGAGATACTTTTCGCTTTGAATTTCTATCACGCTCTG

AGAAATCAAATATATATATATTTCTCTTGATCTTAACTTTAAAGTTTAAA

GTGATATGAGATTTTTACACATACTAAAACAATTTTTTCTCAAATATGCA

TCCATTGATATCCTTGTCTTTGGGTTTGGATCCAAGAGTTTCGACAGCAA

TCTGCGTACATCTGGTGCAATCCAGTTAGGAAATTTGAACTCTCCCCTGC

CAATAGAACATACAAGATCATAACTCCTTCTGTTTATCACTTCCGGAGCA

GCATAGGCAGGGGCACCACATGTAGTGTGGAGTAATCCATTTATATTCCC

ATTTTCATCCAGTAGAAGATTTTCTGGTTTCAGATCACGATGGCACACAC

CTCGGCTATGGCAGTAGTCAACAGCGCTGATCAATTGCTGAAATTATCTC

CTAGCATCATCCTGCTTGAGCTTTCCTTTGGATACCTTATTGAAGAGCTC

ACCACCTTTTACATACTCCATAACAAAGTAAATTTTGGTTTTGCTGGCCA

TTACCTCGTAAAGCTCAACCACATGTGGATGCCTGGTTAGCCTCATCGCT

GAAATTTCGCGCTTAATCTGATCAATCATCCCAACTTTCAGAATCTTCTC

CTTGTCAGTAATCTTAATGGCCACACTCATGCCAGTTATGATGTTCCTAG

CATGGTAGACTTTTGCAAAGGTTGAACAAGGATAGCTCAGATGGAGGCAC

-continued

GGACTCATCAACCTCGGTGAAGGAATTCTTAACTGTCAAGCACATCTTTC

ACCATTCCCTGATTTTGGTGATGACACTAGAGAACAATGAAGAATATGGA

CTTCTTGGAAAGTTTGAAGAATAATTAAGGAATGATGCAGCACCTGGTTA

GCCTTCCAATTACCCAGCAGCAGAATATACAATGAAAGACACACCTGAAA

GAAAGATGAACAAATTTAATAAGTTGGGATCATTGTCAGAGAATATAATC

TCCTGAATAAAATTCTTGAAACTTCTACAAACATAACCAGCATAACAATT

TTTATAACTTGTTTCTGATGTCATTTTTGAACAATCCCAAAACCATAAGG

CATTAGGTGAGTTTTGATCATATTTAAACAGGACTGGATTAAAAAACAAA

GTATTTAGCACATCAATTACATTTCTCTCAGGTAGTCTAGTCGTTTTTAG

AGTTCTTATAAATAAACGATTCATGACCAAGAAGAACAACACAAGACTAA

ACAAGTATGACAGAATGTAAGATTGTCAAAAATCAAGAATAAATCGAAAC

CAGAGATGGCCACACATTATGCAGAAGAAATAAAATTTAATCAAACAATC

AATCAGCAGATGGCAGAAAGCACACTAATACAACAAAATACATCAATAAT

GAACTTGAGATTCATAAAAAAGGAGCATGCAAACAAGTGAGACCTGCATT

CTGTTTTGAATTACATAGACAAATCAAGTCATTCACACTCATCTGCCCAA

ATTAATCGTCTAAGTTGGGAGAGTTTAATGACACTCGAGAAGAAAATGAA

AATTCAGTAAGGTTTCAAATAAGCAAGTATAAATATAACTGAGTTGCCAC

CGTTTTCAGATGAATGTGGTTCCACTTTCCATTACAATCGTTACCGTTTG

GCAGTCTATCTACCAATTTTCATGCTTGGGTCACATGCACTAAGTTATTG

TCAATACATATTGGCAACAAATTAAAATTTTCCAGATGAAAAAAAAAGGA

AAAAATTTACAAATTTGCCGATAAGAGAAAAAGGCAAATAAACACAAACA

CCCCTCTCACCAAGAGAGAGCTTAACTCATGAAAATAACAACCATCCACC

TATACCAGAATTTGGTTTTAAAATATCATAATTTTGTACTGTTTATTTTT

AAACATGTTATTATTTGTAAAAATTGACCAAAGGTGCACTTAGATCTTCT

CATGCTACACAAAAATCAAGTTTAATAAACATTAAGAAATATTTGTTACA

TTTAATAAGGGAGATTTTCATAATAAAAAAAATTCTGAATTTCAATAAAA

ATACATTTGATGATCTATTTTTTGTAGTATAAAATCTTTGTATAACATTA

GAAATTATGAAATGTAAAGTCATAAAAAGGAATATTGATATACTCTATAT

TGTTTCTAAGTTTTTTACTATCCACTTTGTAGTAGTATTGAATAAGTAAA

ATTCTATCAAAATCTTTCACACAAATAAAATCAGGTGAAATCTCAATATT

ATGATTGGGCAAGATTTCCCTCATGAATGATAGAATCTGAATTTTATTTG

ATTCTTGCTTGCTGGTTGATTTTTTCTTAAGAATTTAACAAATATATCTT

TTATATATATATATATATATATATATATATATATATATATATATATATAT

ATATATATATATATATATGCATATATATACTTATATTAGATACATTAAAT

TTCAAATTTCTGTAACAACCTTTGTGAATTATAAGGAAAGTCTGGTCAAC

TAAATAAGCTAATTTACACTCATGCATACAATCGCTTCACTTGAACTTAA

CTCAATCGTCATCATCATTATTATAGTGAGTTAATAGAAATGCAAGATTC

TCATTACTAAAAAAAAATAGTCATTACTAAAAAAAATAGTCATTCCATAA

AAAAATAGCTATAAGAGGTCTTGTTAATAAATATTCTTAAATACTAAGAA

AACTTAAAAATATTAAATAAAAATATAATATTAGTATATTAAAATTGTTT

-continued

GAAATTTAATTTATTATTCAAACAATTTGCTTTTTTAAAAATCTTAACAA

TTTCACTTGTTACAATGTGACAAAACATTCAAGGAAGAAAAAACAAAGTT

AACTTATATGTGGGGAGTGAGAAATACGACAACAAATGACGCTATAAAAG

TAATATATTGTTGATAAATAGAAAAAATAAGTCCTCTAATAAAATTGGTA

AAACAAAATTAAAACTTCATTCAATAATATTTTATCATCTATAATAATTA

TGATAATTACTCTTAAAATCATCTCTACGATGATCTCTGAGGGAATGAAA

ATATAAAATAAATTTCC

BAC99.FASTA.SCREEN.CONTIG1 (SEQ ID NO: 177)

GACCGCTGGGATANGATCCGNCNCTCGTGTGAATNCAAAATCCGTNCCCG

GGGATCAGGCAAAAGTTCCAAAAAATCACAGGTCTGCTTTTCTCAAAGAA

ATCGGAGGAAAGCGAGAAAAGAGAAAAATGATATGAATACCGAAGAACTC

ACTAACGATTGTTGCTTTTTCTCAAATAGTGATTATGTCTTTGGCAACTG

TTCTTGCGGCCATGTCCTCCCTTTGGAGTCTAATTTTGATCTTCGAACGT

TTAAGTTTTCGACATAGGGTTGGGTGGAGCTTGTTCGCACGATGAAGCAA

AATGGGAAAGCTTTTGTTTCGATTGTGGGAACACTGGTAAGCGAAATGAA

CTGGTTTTGAAAAGGGGAAAATAATGGCACTTAATTAGGGATTGGAAGTG

GAAAGAATAAAACTTGATAGAGAAGCACCATATCCACTAAAAAAGGGGTC

TCGATGTTGTAAGAAGTCGGTGGGTCTTTCTACAAGTCCTTGAGCTCCTT

GAGGATGCGCTTTGAAGCCATGGGAGGGACGATTCGCATTCAGATCTGGA

TATCATGTCTTGGTTGTGCAGCCCCGATTACCGCAGTCCCCGAAAGATGG

ATCTGAAAGGGAAAGAGGGACATAGCGCGAGCGAGAGGTCTCTGTGGCCT

CTCCCTGCTGGTTATCGAAATACCCATTGATGGACAACAAATGCTTTGAC

TCTCCCCGAGGGCGCTTTTTTCCTAAAAAGCTTTTCCTCTCCGAAGACCG

CTTTTTCACTACGGTTTCCGCCCAACCCCCCGGGGAATGGCCACTCCCCA

ACATCCCACGTTTCCCATAATTGCCCCTGGCCGTTCCCACCTACAATGGG

CCCCCTTTGCGGAACCGGCCTCGTTTTTCACAAACTTAAAAAACGGCCTT

TACCCTC

BAC99.FASTA.SCREEN.CONTIG2 (SEQ ID NO: 178)

TGACAATAGCCCAAACACAAACACACACTAGGAATGAGTTATCACATTCA

TATATAATAAAATATTAGAGCATGTAAAACATATAATACTTAAAGCTGAA

TTATATAATTAACATCACTTCCCAAAATCACACACATTTTGCACATCCAT

TCAAGTTCATCCACTCCAGAAAATAACATCAAACCACAATTGTTAACTCA

ATGAAAGTCAAACACATGCATTATGCAACAAATACTCTAGACTTAAGCCT

ACATGCAATGTGGTACCATTTTTCAGTGAAAAACCTCGTTGGGCGCCTAA

GAGTACATGACAGGACATGCCTCACAATGGGTAAGTTAGGTCACTTTCAC

TAAGTGAAATCATAGGGAGACCAGTCAGGATCACGTTGTTTTGCGAGAAT

GCTCCAACCATGTGGGAGCGGCACAGGCTTAAAGGAGCACTCAAATCGGA

TGACCCCCAAGGCCTACACTCCGAAGAGTTCGTCAGGGCCTCTCCCTCCT

GATTCAGGTCTAACCCAAAAAAAAATTTGAACACATAGACTCTACCTATG

AATTATGCAATGCACACAACTACTCAATTGTGTGTGTGTGTATATATATA

-continued

TATATATATATATATATATATATATATATATATATATATATATATATGTA

TGTATGTATATTTTTAAAATATATTTTAACTCAGTGCACCTCAAGGTATT

AAACTCGTCGGGTTCCCGCAGTGGATCCTCAAG

BAC99.FASTA.SCREEN.CONTIG3 (SEQ ID NO: 179)

ACCACTTAAGTAAAAAAGAATCACTTGATAAGAAAGAACTACGTAGGTCT

GATTTTCTCATCCCAAATTGAGGAATACGTAGGAGCAAAGGGAAACACCC

TTGTCGACCACAAAAAAGGAAAAAATATAAAAAGGGTATAAAGGATATAA

GAACATAAAAGGGAATAAAAAAATCAAAGTCATGTTTGCACATTCGATTA

AAGGCTGCCGTCCCTTGGGACGGGCGTGTGGGGTGCTAATACCTTCCCCG

TGCGTAAATACAACTCCCGAACCTTTCAAACTTAAAAATTCGTAGATCGC

GTCTTTTCCGGTTTTTCCGACGTTTTCCTCAAATAAACGTTGGTGGCGAC

TCCGCACGTATTCCTTTCGTGGAACACGCATCCCGCGAGTCACGCGTCGC

CCTCCCGCCGAAGGGTAGGTTGCGACAGTTGGCGACTCCACTGGGGACCT

GTTTTAGAGAGTTAGGCCATTTAATCTTGTGCAATGTTTTATCATGACTC

TCCTTGTTGGTCCCCTTTATTTGTCTTATGTTCTTGTGTATATAAACTATT

GTTGCTTTTAGTGTATTTTAAAATGTATGCATGAGGTAAATATTTATTCA

TTTGATGCACACAAACACCAACACTATTTGCACACACTGTGAGTGAAAAA

AAAAGGGCCCTATACCCGGGTTCGTGGGAACATAAGGAGTGGAGGTGAAT

CTGTGATCATGCTAGGTCTCCGACTTGCTTGAACAGTGAACCCTCATCTA

GAGCTTTTCTCTTTGAAAACCTATTGTTGCTAGTAGTCCCTACTGCTACG

ATATGTTCTTCAAAGGGGATGATACCTCTAGAAACCATCAAGAGAGATAT

AACTACCTTGGGGATTATTGCTAAAAGCCTAGTTAGTTCTCTCCCTTATA

GGTCCTTTAAATAGGGGCACGAAGCAAACACGCTGCGTGCCATTTTCACA

CTGCCATGCATGAGTATCATATACCCTTTTGCTTATGTTCAGTAAATATT

GTCATACTGTGTACGTTCCCGCATTGTGTCTTTTGCATAAGCATTGCATA

CGGATTCTTTCTTGATCCCTACTGTAAACAAACCAACGGAGGGTCCGTGT

CGCCTTCTTAAAAACGTGCGTTGGCGGCATTTTGCTACCCCTAGACGTCG

TATCTAAGAAGGGGACAAATTCCCCGGACCCCCGCATTCCTAGATTGCAT

CTGTGTCATATGCACTCCATCATGCATTCATCCATTCCACCCATGAGATA

TCGGAGTTTTGATTTGCACCAGCTTTTATCTCACTTTAGTAAGCATGGGA

ACAAATCAAACCGGCAAGAGGTTTTACCAAGTCAAGGTCAAAAGCCCAGA

TACCACCAGCATCAAGGAATTAGGGCGGTTGATGGAACCCCTCCAAATGC

AAGCCTTCCGCAAGACTTACGGAAAGATCTTAGAGTTGACCATAGCAGAG

GTGTCCATAGAAGCCATTGCATCACTTACCCAATACTACGACCAGCCCTT

GAGATGCTTCACATTCGGGGACTTCCAATTAGTACCAACCATTGAAGAAT

TTGAGGAAATTCTAGGATGTCCTCTCGGGGGAAGGAAACCATATCTTCCC

TCCGGGTGTCTCCCCTCTTTGAGCAGAATTGCAACTGTGGTCAAGGATTC

AGCCAGAGGTTTGGACCGCATAAAACAGACTCGGAACGGCATAGCGGGCC

TGCCACAGAAGTACCTAGAAGACAAGGCGAGGGGTATGGCCAATCAAGGA

GACTGGGTCCCGTTTATGGATGTGTTAGCTTTGCTAATTTTTGGGGTCAC

-continued

CCTCTTTCCAAACGTGGATGGTTTGATAGACCTAGCAGCAATCGACGCTT

TCCTTGCCTACCACCATAGCAAGGAAAGTCCGGTGGTAGCCGTCTTGGCA

GATCTATTTGACACATTTGACCGAAGGTGCGAAAAGAGTAGCGCACGGAT

CATCTGTTGCTTACCCGCCCTCTGTGTTTGGTTGGTTTCACACTTGTTCC

AACAAGACACAAGACATCCATGTCCGCTCCTGAGCCATCGCTCATGTACT

GAAAAGAGGAGAATAGATTGGGACCAGCTCTTGGCCGGGATAGGAGGTAG

AACAATCAGTTGGTTCCCCCGATGGAAGGAAGGAAAAGAAGGAGTCCTTT

CCTCGTGTGGAAGATACCCAAACATTCCGCTGGTAGGGACGAGGGGTTGT

ATTAATTACAATCCCACGCTCGCTATAAGACAACTAGGGTACCCCATGAG

GGGAGCACCGACGGAAGAAAGCATGTCTCCTTTCCTTGTGAGGGATCTCG

GCGCACAAAATTCCAAGACTATACAAAGAATCCATAAAGCATGGGAAACC

CCGTTAAGGAAAGATCAAGAGCTTAGAGGCATTCGTAATGGCATCATTGG

TGGGTACCACCAATGGCTGAAAGTTCGCATACGAGGTTTAGATTGGCTCG

CCAAGTTAAAAGTCGTCAGCGAAGAGAATTTTGAAGCACCGGAAGCGGAT

GAAGAAGTCCAAGCTCTCAAAAGCGAGTTAGGAAAGGCAAAACTCGCCAA

GGAGAAGTTCAAGTTGGCTGCTACACACGTTCGGAAGGAGTGTGCCGGGT

TACGGGAAGAGAATGCAATTACCGCAAGGGCCCTTGAACAAGAGACCAAG

AGGGCTCGCAGGGAAGAGTATGGCCGGAACAAATTTCGCGGAGCTCTATG

GGGTAGCAATAATGAACTCAAGTTGCGAAGGGAAGAAAGGGACCAGTCGC

GAGCACATAGCATGGTTCTGAAAGAGGAGTTGATTACTTGTTCAAGGTCC

AAAAGAAGCTTGTCTCAGCGTCTATGCGAGACAGAAACCAACATGTTAGC

TATCATCGCCAAGTACCAAGAAGAGTTGGGTCTAGCCACGGCCCACGAGC

ATAGAATCGCGGATGAGTATGCCCAAGTATATGCGGAAAAAGAGGCTAGA

GGAAGGGTGATCGACTCTTTACACCAAGAGGCAACCATGTGGATGGATCA

GTTTGCTCTTACCTTGAACGGGAGTCAAGAACTTCCCCGATTGTTAGCCA

AGGCCAAGGCGATGGCAGACACCTACTCCGCCCCCGAAGAGATTCATGGG

CTTCTCGGCTATTGTCAGCATATGATAGACTTAATGGCCCACATAATTAG

GAATCGTTAAAGAAACTTGTATGGTCTCTCAGACCTTGACTAGATATGAT

TTCTTTTTTTATAAAATGAGTTGGTCCCATGTTTCTACTCCAAAAAGCTT

GTGCAAATCAAATCACTCCTACATCTCATCTCTAGCATGCATTTTCTTTC

TTTACCCACTCCTCACGTTTGGTTTTTTAGGGAAAACACCATAACTAAAC

GCGCCGCAAGGGATCCCTATCGCACCAGATCCAAATCTAGAACGATGGGT

GATCAAGAGGAGACGCAGGAACAGATGAAAGCCGACATGTCGGCTCTGAA

AGAACAAATGGCCTCCATGATGGAGGCCATGTTAGGTATGAAACAGCTCA

TGGAGAAGAACGCGGCCACTGCCGCCGCTGTCAGTTCGGCTGCCGAAGCA

GACCCGACTCCCTTGGCAACTACGCACCATCCTCCCTCAAACATAGTAGG

ACGGGGAAGGGACACACTGGGACACGATGGCAGCCCTCACCTGGGATACA

ACCGAGCGGCTTACCCTTATGGATTGCCGCCAACTATTCACCACCCGTCT

TGCAAGAAGATGCGGGCCACATTGCTTCTCCCGTCCATGAAAGAGAGCCT

CCTCAGCAGCCCGACGAAGTCCACAAAGACCCTCAAGATTACGCTCGAAG

-continued

GGATGTCGAGTTCTATCCCCCGATCCCCGAAGGGCCGGCACCAGGCACAT

TGCCTCAACCCAACATCGCAGCACCGCCAATAGTTTTGTCTATGGAAGGG

CCGCCCCCGGCAACTGAAGAAAGGAGGAAGCTCGATCTCCTTGAGGAAAG

ATTGAGGGCTGTGGAAGGATTTGGGGACTATCCGTTTGCAGACATGACGG

ATCTTTGCTTAGTACCCGATGTTGTTATTCCCCCGAAGTTCAAAGTGCCG

GACTTCGACAAGTATAAAGGGACGACTTGTCCCAAAAACCACCTCAAGAT

GTACTGCCGTAAGATGGGCGCCCATTCTAAAGATGAAAAGCTGTTGATAC

ACTTCTTTCAGGATAGCTTGGCCGGAGCTGCGGTAGTGTGGTACACTAAT

TTGGAAGCTTCCCGTATCCGTACTTGGAAGGATCTGATTACCGCCTTCCT

AAGGCAGTATCAGTACAATTCTGATATGGCTCCAGACCGTACTCAACTGC

AGAATATGTTCAAGAAAGAGGGTGAAACCTTTAAAGAATATGCGCAGCGA

TGGAGGGATTTGGCGGCACAAGTAGCTCCTCCCATGGTTGAGAGAGAGAT

GATTACCATGATGGTAGACACTCTGCCAGTGTTCTACTATGAGAAGCTAG

TGGGTTACATGCCGTCCAGCTTTGCGGATCTGGTGTTTGCCGGGGAAAGA

ATCGAGGTGGGATTGAAGAGAGGAAAGTTTGATTACGTTTCCTCCACAAA

CGTGAACGCCAAAAGAATCGGGGCAACAGGGGCAAAAAGGAAGGAAGGAG

ATGCCCATGCCGTCTCTTCAACGCCCGCATGGGTCAAACCCCAGCAAACA

CCTCATGGTACCCATCAGTACGCGCAACATCACCCAAGCTTCTCGGCTCC

TGCTGGGAACGCCTCTAGCTCAACACCCGTACAGCCTAAGGCACCCACCC

AGAGGGAAGCTCCCCAAGTTCCAACTCCGAACGCGACTCGACCAGCCGGT

AATTCCAACACGACAAGGAACGGCCCTCCGAGGCCGTTGCCGGAATTCAC

CCCGCTCCCAATGACGTACGAAGATCTTCTACCATCCCTCATCGCCAATC

ATTTGGCCGTGGTAACTCCCGGAAGGGTCTTCGAACCCCCTTTCCCGAGG

TGGTATGACCCTAATGCAACTTGCAAGTACCATGGGGGCGCCCCGGGGCA

TTCCATCGAAAAATGCTTGGCCCTTAAATACAAGGTCCAACATCTAATGG

ATGCCGGATGGCTGACTTTCCAAGAGGATCGGCCCAATGTGAGGACCAAC

CCGCTCGCCAATCATGGAGGGGGGGCAGTTAATGCAGTTGAATCCGATAG

GCCCCACAGGTCTAAACCGTTGAGAGATGTGGCAACCCCTAGGAGGTTTA

TCTTTGAGGCCCTACAGAAGGGAGGTGTAATTCCCCATAGTGGGTGTAAG

GAGGATTCCTGTCTGCTACATCCCGGCGAGATGCATGACATGGAGACGTG

TTTGGAAGTAGAGGAATTGTTACAATGGATGATAGACCAAGGTCGACTAG

AAGTCGGCATTAAAGGAAAAGAAGAGCCGCATATATGCATGCAATCTACG

GAGGGGAGCGGTATTGCGAAGCCCAAACCCTTGGTGATATACTTTACTAA

AAGTGCAGCCTCGCAAAAGCCTGGGCATCCCTTAATGGTCAAACCTGTTC

CTTTCCCGTACCAGAATAGTCACGCGGTCCCGTGGAGATATACACCTCCG

GAGAAGAAGGAAGAAGAGGTCACAGACATCAGCTCGCTGTCGGCTAAAGT

AACAAATATCACGGGACTGAGTGGTGTGACCCGTAGTGGTCGTGTGTTCG

CACCTCCGGACCTACCGGTCCAACCCGCCGACGTCAAGGGAAAAGGAAAG

GTGGTGGAGGAACAAGATGGCGAAGCACCCCACGCTTCGAATAAAGATAT

TCCAGCAAAGGGGCCCCCAGAGAAAAGGGATGGTAGAAAGGAGGTGTCGC

-continued

TAGAGGAAGCCAGCGAGTTCCTTCGGATAATTCAGCAGAGCGAATTCAAG
GTTATCGAACAGCTCAACAAAACCCCGGCTAGGGTCTCGCTGCTAGAGTT
ACTTATGAGCTCCGAGCCTCATCGGGCTCTGCTAGTAAAAGTGCTGAACG
AGGCTCACGTGGCCCAAGATATTTCGGTAGAAGGTTTCGGAGGGCTGGTC
AACAATATCACTGCCAACAACTATCTTGCCTTCGCCGAAGAAGAAATCCC
CGCCGAGGGGAGAGGGCATAATAAGGCTTTACACGTATCAGTCAAGTGTA
TGGACCATATCGTGGCCAAGGTACTTATCGATAATGGTTCCAGTTTAAAC
GTGATGCCTAAGAGCACTTTGGACAAGTTACCATTCAATGCTTCCCATTT
AAAACCAAGTTCAATGGTGGTTCGGGCCTTCGACGGCACTCGCCGAGAGG
TTAGGGGAGAGATCGATCTCCCAGTACAAATAGGCCCTCACACCTGTCAA
GTCACCTTCCAAATAATGGACATTAACCCACCCTACAGTTGCCTGTTGGG
GCGCCCGTGGATCCATTCAGTGGGTGTTGTGCCTTCTACACTCCACCAAA
AGCTGAAATTCGTAGTGGAGGGGCACTTGGTCATCGTGTCAGGCGAGGAA
GATATCTTGGTAAGCTGCCCATCCTCCATGCCTTATGTGGAAGCCGCAGA
AGAATCGTTAGAAACCGCTTTCCAGTCTTTTGAGGTGGTCAGCATTTCCT
CCGTGGACTCCCTCTTTGGGCAACCTTGTCTGTCCGATGCGGCGGTAATG
ATGGCCCGAGTTATGTTGGGGAACGGTTATGAACCCGGGATGGGTTTAGG
CAAAGACAATCTGCGGCATAACTAGCCTGATAAAAACCCAAGGAAATCGT
GGGAAGTATGGTTTAGGCTATAAGCCCACTCAGGCAGACGTGAAAAGAAG
CATCGCGGGAAGGAAGAACAGTGGTCAGAGCTCGCGTTGGAGACAAGAAA
GTGAAGGAAGCCCGCCCTGCCACATAAGTAGAAGTTTTATAAATGCGGGT
CTGGGAGACGAAGGTCAAGTGGTCGCGATATGTGAAGATGATGTTCCAAG
AACTCTGGATTTGGTCCGACCATGCCCTCCTGATTTCCAGCTGGGAAATT
GGCGGGTGGAGGAACGCCCCGGCATTTACACAACAAGCATAATGTAAACC
TTTACGTTTTTAAAAGCTCTATAGTTGGGCCTAGGCTTTAGAGTTCATTT
TGTTAAGGCTTTGTGTCTTTTGTCTTTGAATTTATAATACAAAGATCTTT
CTTCATCTGTTCCTGGTCTCTACCCATTCTCATTCATTTGCATGTTTACT
TCTTTTTCTGAAACGGCAGATCCGATGACGAGTCCCCCGAAGGTACTAAT
ACCTGGGACCCGTCTATCAATTTCGAGCAAGAAATGAACCAAACGGAAGA
TGAAGGAGATGAGGGGGTGGGACTTCCTTCGGAACTAGAAAGGATGGTTG
CCCATGAGGACCAAGAAATGGGGCCTCATCAAGAAGAAACAGAGCTAGTA
GACTTGGGAATTGGCAGTGGAAAGAGGGAAGTAAAGATAGGTGCAGGCAT
TACCGCACCTATCCGTGAAGAATTAATAACCCTGCTAAAAGACTACCAAG
ACATCTTTGCTTGGTCATACCAAGATATGCCCGGTTTGAGTTCTGACATT
GTGCAGCACCGATTGCCTCTGAATCCCGGGTGTTCCCCAGTAAAACAGAA
ATTGAGGAGGATGAAACCCAAAACGTCCTTGAAGATAAAAGAAGAAGTGA
AGAAGCAGTTTGACGCTGGATTTCTGGCCGTCGCTCGGTATCCAGAATGG
GTTGCCAACATCGTACCAGTTCCTAAAAAGGGTGGGAAAGTACGAATGTG
TGTAGATTACCGGGACCTGAATCGGGCCAGTCCCAAGGACAATTTTCCGC
TACCACACATCGATATCCTCGTAGATAACACGGCCAATTTTGCTTTATTT

-continued

TCCTTCATGGATGGTTTCTCTGGTTACAATCAGATAAAGATGGCACCCGA
GGATATGGAAAAGACTACTTTCGTCACCCTGTGCGGAACGTTCTGTTACA
AGGTGATGTCCTTTGGACTCAAGAATGCCGGGGCAACTTATCAGCGGGCC
ATGGTAGCTTTGTTCCATGATATGATGCATCAAGAGATCGAGGTCTACGT
GGACGACATAATTGCTAAATCTAAATCTGAGGAAGAACACCTTGTCAACC
TGCGGAAGTTGTTTGAAAGGCTTAAGAAATATCAATTAAGGTTGAACCCC
GCTAAGTGCACCTTTGGGGTCAAATCAGGGAAATTGCTTTGGTTTCGTTG
TAAGCCAGAAAGGGATAGAGGTAGACCCCGAAAAAGTGAAGGCTATCCTT
GAGATGCCGGAACCCCGTACAGAGAGGCAAGTCCGAGGTTTCCTGGGGCG
CTTGAATTATATTGCCAGATTCATATCGCAGCTCACAGCCATTTGTGAGC
CGTTGTTTAAACTCTTGCGCAAAAACCAAACTGATCGGTGGAATGAGGAT
TGCCAAGAGGCTTTTGGAAAGATCAAAAAGTGCCTAATGAATCCTCCTGT
GCTTATGCCACCAGTACCTGGAAGGCCTCTCATTTTGTACATGACAATCT
TGGACGAGTCAATGGGGTGTATGCTGGGGCAGCATGACGAATCCGGGAAG
AAAGAGCGCGCTGTTTACTACCTAAGTAAGAAGTTCACGACCTGTGAGAT
GAATTACTCCTTGCTCGAAAGAACGTGTTGTGCTTTAGTATGGGCGTCCC
ATCGCCTAAGGCAGTACATGCTGAGCCATACTACCTGGTTGATATCCAAA
ATGGACCCGGTTAAGTACATCTTTGAAAAGCCAGCTCTCACAGGACGAAT
CGCCCAGTGGCAAGTCCTGCTATCTGAGTTTGATATAGTCTACGTCACCC
AAAAGGCGATAAAAGGAAGCGCTTTGGCAGATTATTTGGCTCAACAGCCT
CTTAACGACTACCAGCCCATGCATCCGGAATTCCCCGGATGAGGACATCAT
GGCCTTGTTCGAGGAAAAGTTGGACGAAGATCGGGACAAATGGACTGTAT
GGTTTGACGGAGCGTCAAACATTCTAGGTCATGGCGTTGGGGCAGTGTTG
ATCTCTCCGGACAATCAATGTGTACCTTTCACAGCCAGGCTAGGATTCGA
CTGCACCAACAACATGGCCGAATATGAAGCATGTGCCCTAGCCGTCCAGG
CAGCAATTGACTCCAATGCCAAACTACTCAAGGTGTACGGCGACTCAGCG
TTGGTAATCCATCAGCTGAGAGGGGAATGGGAAACTAGAGATCCCAAGCT
GATACCCTACAAAGCCTACATCAAGGAATTGGCTAAGACTTTCGATGAGA
TCTCCTTCCATCATGTTCCCCGCGAGGAAAATCAAATGGCGGATGCACTT
GCTACATTGGCATCTATGTTCCAGCTAACACCGCACGGGGACCTACCCTA
CATTGAATTTTCAGTGTCGTGGCAAACCCGCACATTGTTGCCAAGTGGAA
GAGGAACGGGACGGAAAGCCCTGGTATTACGACATCAAGCGATATGTCGA
AAGCAAAGAATACCCGCCGGAGATTGCCGACAACGATAAAAGGACATTGA
GGAGGTTGGCAGTCAGTTTCTTCATGAGCGGAGGCACACTGTATAAGAGA
AATCACGACATGACACTCCTGCGATGTGTGGATGCCAAGGAGGCAAATCA
CATGATCGAGGAAGTCCATGAGGGCTCGTTTGGAACACACGCCAACGGGC
ATGCTATGGCCAGGAAGATCTTAAGAGCAGGTTATTACTGGCTTACCATG
GAAAGTGATTGTTGTGTCCATGTGAGGAAGTGCCACAAATGTCAAGCGTT
CGCAGATAATGTCAATGCCCCACCACATCCTCTGAATGTCATGTCCGCCC
CTTGGCCTTTCTCCATGTGGGGAATAGATGTCATCGGGGCCATTGAGCCC

-continued

AAGGCCTCGAATGGTCATCGCTTCATCCTCGTAGCGATAGATTATTTCAC

CAAGTGGGTCGAGGCGGCTTCATATACCAATGTCACGAGGAATGTGGTGG

TCAGGTTCATTAAGAAAGAGATCATCTGCCGATATGGTTTGCCAAGGAAG

ATTATCACGGACAATGGCACCAACCTGAATAATAAGATGATGGCAGAAAT

GTGCGAGGAGTTTAAAATCCAGCATCACAATTCCACGCCCTACCGGCCAA

AGATGAATGGAGCCGTGGAAGCAGCCAATAAGAATATCAAAAAGATTATC

CAAAAGATGACCGTGTCATACAAGGATTGGCACGAGATGCTCCCATTCGC

GTTACACGGTTACCGGACTTCAGTGCGAACGTCAACTGGGGCAACGCCAT

TCTCATTGGTATATGGGATGGAGGCGGTGTTACCGTTTGAGGTAGAAGTC

CCGTCATTAAGGATTTTGGCAGAATCCGGGTTAAAGGAATCAGAGTGGGC

TCAAACACGCTACGATCAGCTCAACCTCATTGAGGGTAAGCGCTTAACGG

CCATGAGTCATGGGCGCTTATACCAGCAAAGAATGAAGAGTGCATTCGAC

AAGAAAGTACGCTTACGCAAGTTCCATGAGGGAGACCTTGTGCTAAAGAA

AATGTCCCATGCTGTCAAGGACCATCGAGGGAAATGGGCCCCGAACTACG

AAGGGCCTTTTGTCGTGAAGAGGGCTTTTTCCGGAGGAGCTCTGGTGCTT

ACCAACATGGATGGCGAAGAGCTACCTTCACCCGTGAACTCTGATGTCGT

CAAACAATATTATGCTTAGAAGCTGGGGCAATTAAGGATGTCGCTGCATG

TTCTGTATCTTTATGCGTTTTCTGGATTTCCCCCAGGGATTTCCTGTCTG

TTGTATCTCTCGTTACAATCTTTCAAAGAAATGAACGTGGATTCGAGGCT

TTTAGTCCTCACGTTAGTTTCACATCTTGCGTTAATTTGTGATCACCTGA

GCCCTTCCGCTCAGTTCATGGGATCCCCCAAGCGCTTAATTAGAATTGAA

CCTGAACCAACTTTCCCTAAATTTTCTGCGTTTGAAAACATTCATGCATA

CGCATACGCATACGCATGTATATTGTTGTGGTAAAACAGGGGCAGGATCA

CCTTGGGCTACTTTCTGGAGTGAGGACAAAACAGGAATGGCAGAAACCAG

TCAAGGTAGGGTAATGATGCGGCCAAAATTGGCCATACCTGGTTGTTTAT

TACTTGCAGGTACTTAAGGATGAACGCAAGCGGGGATGGGGTCACGACCG

ACCGATCGTTGCCCTTCTCTGTGCGAAACAAGCAGGGAATGTCGCTGCAA

GGCAGCCCCGTATCCTTTCTATTTTGTAGCTTTCTTTTACTATTTGTTTG

TTTTAAAAAAAGGAAAAGAGTAATAATAAGATAAGTAATCAACGCCTGAT

TCTAACCTAAGTAAGTTCAAGTTAGGCAAAAGGCTAATCCATGAGAAGGG

AGGGGACATGGTCAATGTTCCCCTCAAAAAAAAAAAAAAAAAAAAAAAAA

GTGCAGGTTAGCTCGCCTGGGCGAGCTGGGCTCGCCTGGGCGAGCCACCT

CTGCACCAAAATATAAAAATGACGAAGGGGGGGATGTTTTTTTCATTCA

AAAACTTCCCCCCCTCATTCAAAAAAAGAAAGCTCACGGGACTCACGGAT

TTTGCAGCCCTTAGGTCACCATTTTTTGCGTTTTTGATTCCGTTTTGCTC

TATTATTCGTCTCCAACAAGTAAGTACCTCATTCTTGGGCTTTCTAGCTT

TCCATTGATGTATTTTGGTGCTCTAAATTGCATGTGTTTGCTAAGAAACG

TGAGGGATTTATCCTCAAATTGTTGCTTGTTTTTGTTGAATTGAGGGGTT

GTAAGGGATGGCCTTGGCCTAGGGTGTATTCTGAAGTAATGGCGCATGCC

ACATTGTCCCCATTCTCTTGATATTCGTGCCTAAACATGCGCCCACCAAG

-continued

TGCTCGGTGAAATGCCTCAACGACATATGAGCATGGTTTTGTGAGCTTTG

GGTTGTGGGACTGTTTTATATGTATAGGGACAGCATGAAGGATTTAAAAT

GAATGCCCGAATGCAATTCTAGGCCTAGGAACCCAAGCTTTTAATTTCAA

TACAAGGAAGCATGACTTACGCCTAGGAATCTAAGTTTTGGTTTTGAATG

TAAAAAGGCATGAATATTAGGACATGTTTGAGAGGTTGTTATTAGAATTT

AAATTTGGCTGCCCCATGAGGAATACCTTGCACCTAGGTAGCATGGAAAA

TACCTTTCAACGGTATGTATATATGTGAATATATATAGCATGGAAATGCC

TTGCAAAATATGAATATATATAGTATGAAAATGCCTTGCATAATATGAAT

ATATATAGTATGAAAATGCCTTGCATAATATGAATATATATAGCATGAAG

TGCCTTGCAAAGTGTTGGATGGGTAGCGTAAAAGTGTTTTTCAAAATATA

TGTATTTGTGAGTAGGTAATAAAAGAAACCTTCCAAAAAATGTATATATA

TATAGGATGTAGCATGAAAAGGTTTGTCAAAAAATATGTACATGGATAGG

TGTCGCAAAATGCTTCACACAAAATTTTTATGTGTGCAAATACGTATGT

GTCATAAAATAGCACGACCCCAATATGATTATTTTATAAAGTGCATGTTG

ACACTCGGGCCATGAGAAGTGTTGTTTGGCCCTTGTTTGTAATGATTGTT

ATATTTCTTGTAAACTAACTTTCCAAATGTTTGCCTTCGCAGGAATGGCC

CCGAGGAAGCTTGCCTCAAAGAGGTCCAGGAAGGACAAGGCGGCCGAAGG

AACTAGTTCCGCCCCGGAGTACGACAGTCACCGCTTTAGGAGCGTTGTAC

ACCAGCAGCGCTTTGAAGCCATCAAGGGATGGTCGTTTCTCCGGGAGCGA

CGCGTCCAGCTCAGGGACGACGAGTATACTGATTTTCAGGAGGAAATAGG

GCGCCGGCGGTGGGCACCACTGGTTACTCCTATGGCCAAGTTTGATCCAG

AAATAGTCCTTGAATTTTATGCCAATGCTTGGCCAACAGAGGAGGGCGTG

CGTGACATGAGGTCCTGGGTTAGGGGTCAATGGATCCCGTTCGATGCCGA

CGCTATCAGCCAGCTCCTGGGATATCCGATGGTGTTGGAAGAGGGCCAGG

AATGCGAGTATGGCCAGAGGAGGAACCGGTCTGATGGGTTCGATGAGGAG

GCCATCGCCCAGCTGCTATGTATACCGGGGCAGGATTTTGCCCGGACCGC

TGCAGGGAGGCGAGTGCGAGTCATGCGCACCAACATGACCACCCTGACCC

AGATATGGATGACGTTGCTCCTCAGCAACATCCTGCCCACCGATCATAAT

TCCGACCTCCCCATGCCTAAGTGCCAGCTGGTCTACGCCATCCTGACACG

GATGAGCATCCATGTGGCTCAGTTGATCGCTGATGCCATCTATATTTTTG

CAGGTATGGCGCCCACTAGGCACCCTTTGGACCCAGATAAGTCCAACAGG

GCTCTGGGATTCCCCGCACTGATCACAGGACTCTGCCAGTCGTTCGGAGT

CCCCGTTGCACCTACCAAGGTGATTCGGCCGCCCATCACCCGGGCTTTTA

TTGAGAAGTACTGTACCCAGAGACAGGCTCAGGGTGATGCTCCACAGGCC

GCAGGCGTGCCACCACCACCTCATCAGGCTGGCCAGGCTGGGGCATTTGA

CATAGAGCAGTATTTACGGCATTTGGTTCGCCAGCAGGCGGCCAACCACC

GAGCACATGTACGGACCCATGATTGTCTGTACCAGATGAGCCTTAGCATG

CAGAGCCAGGGCTTCGCTCCTTTTTCATGCCCTACTCCAGACCAGTTCAG

GGCAGAAGTTGCATGGCCCGGAGATTGGCCCGAGGCCCAAGCAGGAGAGG

CACCCCCAGAAGCTCCCGGCGATGGAGAAGAAGCCCACGAGGATGAGGAA

-continued

ATGGCTGATTTGCTTGACTTCTTGGGAGGGAGTGGAGACACGTGACTGGG
AGATCCCCAGATTCATGTTTTCTTTCATATTCTTTTGTCATTTTTTTGTT
CTATGTTATTGTTTTGACTTGAGAGACTAACGTTTGTTTTTGTTGTTTCG
ATTGTCATTTTGTACAGTGCATACATTTTTGTTTAGATTGGTGCGTTAGT
ATTTATATATCATTACTATCGATGATGTTTGAAATTCTGGAACCGTGTAG
AGTTCTTCGTTTAGGAACATCGTCCAAAGTATATATGTAAAATAAACAAA
AAAATCATGATAAAAGTAAAAAATAGAGAAGGAAAGAAAATGAAATAGAA
AAGGAAAGAAAATGAAATAGAAAAGAAAAGAAAGTGATAAGGAAAAAGAG
AAGGCAAGAGAAAATAAGTTGTCTAGCTAAAAAACCAACATGCTTTTGAA
AAGAGACGATTTCCAACTTTTCTTTGAAAAAAGTTCATTGATCATAACCA
ATTCTTGGAAAATGTGTCTACACCTGAAGGGTGAATGCTGTGAAATTTCC
CCGGATGCCCGAAATGGACTCGGATGAATGCACAAATTGATAAAAGAACA
TATTTTGGAAACATTGGGTCGATTAAAATAGAGGGAATGAATCCTGAGCC
CTAGCATCACATGACCATAAAAGTTTGACACTTGAGTGTCCGCGTAGATG
CATGCATGACCAGTTTTGCATAAAGTTTCCAAATCATCATTTTCGCATTT
GTGTCATGGAAATAATGTGGGGCATCCCTTTTATCCTTGAACCAAACCAA
ACCCTGACATGTATCATGTCTAGCCATTCTACAAACCTTGATTCAAAATC
ATGACTCACTATAATCCTTACCCTCGGAAGCAAAAAAAGGAAAGAAGGAA
ATTTTCCAATCAAAGAGAAAGCAAAAAGAAAAGAAAGGAAATTCCCAATC
AAAGAGCGGGAGAAAGCAAAAAGAAAAGAAAGGAAATTCCCAATCAAGAG
TGGGGGAAAGCAAAAAGAAAAGAAAGAAAATTCCCAACCAAAGAATGGGA
GAAAGTAAAAAGGAAGGAAAGAAAGTTCTTGATCAAAGAAACTAGAAGAA
ATGTGCAGAAAGGTCTTTTGACCAGACAATATCTGAACAATACAGAATTG
TCACCAAATGAACAAAAAAGAAGGAAAGGAAACCACGACCTAAAATGGTC
TTCTCCCTTTGTTTACCAACCAAAATCCCGTGCGCTAGCGACCTTTTTTC
TCGCCCCGCACTAAACAAAAAAAAACAGACAGAAAAAGGAAAAGCTAGAA
AAATCAAAAGCCAAAAACACACAAAAGCCGAAAGAAGAAACCACCAAAAG
AACCCATTCCCAAGGGAAGCCCTATTGATCCATGATCACGCGTGTAATTT
TTGATTTGATAGGAAATAATTTGTAAAGTCAAGTCATGACATATCTATGG
TTCGGAATTAGGATGAAACACTTACCTGTGCGAGATTGATACACTTTGAG
TAGATTTCTTCTATTTTTGTCGAACCCAGTGTTTCCTCTAAATGGTCATT
TAGAAACGAAATGCTAACATCCAAGATCTCATTTATGGTTATGGGGGGAT
CCCATCAGCAGACTCTCCTTCCCTGGTAGGCGCATTGTTTGTCACTCAAA
AAAAAAGCATATGCTGCTCTAAATCAGTTGGAATATTTGTCTCTTTGCTA
AAGCATGTTTGCATTTTAGTGGAGAAAACAACGAAACTTTTTCAAGCCTC
ACAAGTTATCCAGAACTACGTAGGTCTGAGTTCCTCATTGGAGGATACGT
AGGAGCAAGAGCCTCGCTTTTGTCGACCACACCGCCTTTTGTTGCCATAA
CTCAAGAGCTGGTAGTACGCGGAGATACCTTACGCTTATCCGCACCCCTT
TTGCCATTCAGACACAGTCGTGTCCGTTGGCAAGCAGAGACCAAGTTTGG
TCATTCTGCACACATGATACGAGGAGATACCTTACGGTTATCCGCCCCCC

-continued

TTTGCCATTCAGACACAGTCGTGTCCGTTGGCAAGCAGAGACCAAGTTTG
GTCATTCTGCACACATGATACGCGGAGATACCTTACGGTTATCCGCACCC
CTTTTGCCATTCAGACACAGTCGTGTCCGTTGGCAAGCAGAGACCAAGTT
TGGTCATTCTGCACACATGATACGCGGAGATACCTTACGGTTATCCGAAA
AAATTTGCCATTCAGACACAGTCGTGTCCGTTGGCAAGCAGAGACCAAGT
TTGGTCATTCTGCACACATGATACGCGGAGATACCTTACGGTTATCCGCC
CCCCCTTTGCCATTCAGACACAGTCGTGTCCGTTGGCAAGCAGAGACCAA
GTTTGGTCATTCTGCACACATGATACGCGGAGATACCTTACGGTTATCCG
CCCCCCTTTTGCCATTCAGACACAGTCGTGTCCGTTGGCGAGCAGAGACC
AAGTTTGTTCATTCTGCACACATGATACGCGGAGATACCTTACGGTTATC
CGCCCCCCTTTGCCATTCAGACACAGTCGTGTCCGTTGGCAAGCAGAGAC
CAAGTTTGGTCATTCTGCACACATGATACGCGGAGATACCTTACGGTTAT
CCGCCCCCCTTTGCCATTCAGACACAGTCGTGTCCGTTGGCAAGCAGAGA
CCAAGTTTGGTCATTCTGCACACATGATACGCGGAGATACCTTACGGTTA
TCCGCCCCCCCTTTGCCATTCAGACACAGTCGTGTCCATTGGCAAGCAGA
GACCAAGTTTGGTCATTCTGCACACATGATACGCGGAGATACCTTACGGT
TATCCGCCCCCCTTTTGCCATTCAGACACAGTCGTGTCCGTTGGCGAGCA
GAGACCAAGTTTGGTCATTCTGCACACATGATACGCGGAGATACCTTACG
GTTATCCGCCCCCCTTTGCCATTCAGACACAGTCGTGTCCGTTGGCAAGC
AGAGACCAAGTTTGGTCATTCTGCACACATGATACGCGGAGATACCTTAC
GGTTATCCGCCCCCCTTTGCCATTCAGACACAGTCGTGTCCGTTGGCAAG
CAGAGACCAAGTTTGGTCATTCTGCACACATGATACGCGGAGATACCTTA
CGGTTATCCGCCCCCCTTTGCCATTCAGACACAGTCGTGTCCGTTGGCAA
GCAGAGACCAAGTTTGGTCATTCTGCACACATGATACGCGGAGATACCTT
ACGGTTATCCGCCCCCCTTTGCCATTCAGACACAGTCGTGTCCGTTGGCA
AGCAGAGACCAAGTTTGGTCATTCTGCACACATGATACGCGGAGATACCT
TACGGTTATCCGCCCCCCCTTTGCCATTCAGACACAGTCGTGTTCGATGG
CAAGCAGAGACCAAGTTTGGTCATTCTGCACACATGATACGCGGAGATAC
CTTACGGTTATCCGCCCCCCTTTGCCATTCAGACACAGTCGTGTCCGTTG
GCAAGCAGAGACCAAGTTTGGTCATTCTGCACACATGATACGCGGAGATA
CCTTACGGTTATCCGCCCCCCTTTGCCATTCAGACACAGTCGTGTCCGTT
GGCAAGCAGAGACCAAGTTTGGTCATTCTGCACACATGATACGCGGAGAT
ACCTTACGGTTATCCGCCCCCCCTTTGCCATTCAGACACAGTCGTGTTCG
ATGGCAAGCAGAGACCAAGTTTGGTCATTCTGCACACATGATACGCGGAG
ATACCTTACGGTTATCCCCCCCCCCTTTGCCATTCAGACACAGTCGTGTT
CGATGGCAAGCAGAGACCAAGTTTGGTCATTCTGCACCCATGATACGCGG
AGATACCTTATGGTTATTCGCACCCATTCTTTTGCTATCTGTAAGACAGA
ACGCTTGATAGCATGCAGGGGCTGACACAGTCTTCTGCACCTTTTGTTCC
TCTGGGAACAACAAGTCATTTGCATGTGGAGATTTTATGGTCACCCGCGA
CTCTCGTCGAAACGAGAAGGACGAAATTAGTGTCTTATCTTTACTTTTCT

-continued

TTTATCTCCAATAAAAGACAAGTAAAGAGGGGCAACTGTCATACCCTAAT

TTCGTCCGGGAACCTTTGCTCGATGACATGCGACCATTCTTTGGTCCTTG

TGAGGTGCTTGGCACCCATCATTAGGCAATTTATGAAATTCCAGGACATG

CCGAAAAACCAAAAAAAATATTGATGCACAATCCGTAAGTTTCCGTGACA

CACCGGAAATCAAAAGGAAGCATCGTTGCATAATTAAGTGAGGTTCCGTA

ACATTCCGTAAGTCAAAAGGGGATGATTATGTAATTCGCAAGGTTCCGT

AACATTACGGAAAGAAAATAAGTATCGTTACGAAATTCGTAAGTTTCCGT

AACTTTACGAAAAAAGAATCACCAAAAAAACAGCAGAGGGGGTGTATTTA

GTAAAAATGGGGGTGCAAATAGCACCCAGGCCCACTTGGGCCCTCCAGAA

GATTCCTCCAGAAGGCGGTTGCTTCTGGAGGAAGCAACCCTGCTCGCCTG

GGCGAGCTGAGCTCGCCTGGGCGAGCTGGGCGGCAAGCATCTCCCCTATT

TTGCTATAAATAGGGGAGAAAATGAAGAAGAAAAGGATCCCAGCCCTTTA

GGCACTTCTCTCTCTTTGGAATTTGCTTGGAAAAATTGTTTCCGTGAAGA

-continued

AAATCTAAGCCGAGGCGCTTCCGAAACGTTTCCGTAACGTTTTCCGTGAG

GAATCTCGCAAAGGTTTGAACCGTTCTTCGACGTTCTTCATTCGTTCTTC

ATCGTTCTTTGATCTTCAACGGGTAAGTACCTCGAACCAAGCTTTTCGAT

TCATTCTATGCACCCGTAGTGGTCCACATTGTGTTTCGTGCATTTTGATT

CTCATTTTGTTTACTCTTTATACCCCCTGTTGACGTGCTTAAGCCATTTT

ACTTAAGTCGTTTCTCGCTTAACTTAAAAATAAAATAAATTTCCACCGAA

CGTTTGAATTGTATTATCCATTAGCTTCGGTTAAAATAAATTCCGACCGT

TCGGTCATGCCGTAACCACGTTGGAAATCAAAAAGAGGTAAAAAATAATA

TAATAATCAAAAAGACATCTTTTAGTAAAATAAAGCGGAAAATCAATCGG

ACGTTTTCTCTTTGGGATTTCTCATTCTTAACCGAATTGATTAATAACTA

AAGTGAAACTAAGGCTAACATCAACTCGCCTAGTCAAGCTCGTCCACAAA

AATAAGCTTTTGAAGTTTGTCATTTCAATTTCTCACTAAGTAAAAT

BAC99.FASTA.SCREEN.CONTIG4 (SEQ ID NO:180)

TCACTGAATATATTAATAATAAAATTTTTATATAAATAAGATTCAAAGGATAATCACCAACCAAGAAATTTTATGGA

AGTATTTATCAAATAATTACAATAGATATATAACATAAAAAAAAGAGTTGAATTGAATAATAATTTTTCATGCCATC

ATTTCAAAAGAATTACTTTAATCACTCTCTTTATATTATTATTATTATTATTATAACATCTTCACAATATTTTTTATTTT

ATTAGTATTTATTGATTTTATTTAATAAAAAATCACACACTTTTCTTTTTGCACACATCTTTAATCTACATATAAGGAT

ATTCAAATCTTGACTTCATTAATATATATTATTGTTTTTAGGGATCAATTAGCATGTGTCTTTTCTTTAATTCTTTCTCT

TTTAATTTGTTCAACATTTTTATTGTGTTAATAATTTTTTAATCTCATTTTTTTATTTTCCTCCTAACAAAATTTATTCT

ATATATAAGAATTAATAAAGATTTAAATCTTTTACCACTTGATTAAAAAACATAAATTACTATCAATTATTTTAACTT

TTTATAAAATCATGATTCAGATCTTTATACAATAACATATCTCATCATGTGTTAGTTGTTTATATCATCACTCTTTAAA

TCTCTTGAGTCTTTAGTTTAGAGGAGCTAAATTCAAAATAGAAATATCAAGAAAGTAACATATGTGAGGATCAAAAG

TAAAGAGACTCCCAACGTGATAAGTCACCCACCACCATAATAATACAAATAATAAAAATAAAAAAGACCATACTTT

TGTCTTGCACAGCAGAACGAGTGAAGGTGAAGAGAGTTGACTTAAGCCAAATCTCATCACATCAGTTCATAGCAAC

CAATTCCCTTGCCTTTGTCTTTCTACTCTGATCATCTTTTGTTCTTGAGATAATGGCTGCAGCACTGGTCGGTGGTGCC

TTTCTCTCTGCTTTCCTTGATGTGCTTTTCGACAGGCTGGCTTCACCTGACTTTGTTGACTTGATCCTTGGAAAGAAGC

TTAGCAAGAAGTTGCTTCGAAAGTTGGAGACCACTCTCAGAGTGGTTGGAGCTGTGCTTGATGATGCCGAGAAGAAA

CAGATCACAAACACCAATGTCAAACACTGGCTCAATGCTCTCAAAGATGCTGTCTATGAAGCCGATGACTTACTCGA

CCATGTTTTCACCAAAGCTGCCACCCAAAACAAGGTAAGAAACTTGTTTTCTCGCTTTTCCGATCGGAAGATCGTTA

GTAAGTTGGAGGACATAGTTGTCACCCTAGAGTCTCATTTAAAACTCAAGGAGAGTCTTGATTTGAAAGAGAGTGCA

GTGGAGAACTTGTCATGGAAAGCTCCATCAACATCTCTGGAAGATGGATCTCATATATATGGTAGGGAGAAAGATA

GGGAGGCCATAATCAAGTTGTTGTCGGAGGATAACAGTGACGGTAGTGAAGTGTCTGTGGTTCCTATTGTGGGCATG

GGTGGGGTTGGAAAAACTACTTTGGCCCAATTGGTGTACAATGATGAGAATTTGAAAGAGAAATTTGATTTTGATTT

TAAGGCATGGGTTTGTGTTTCTCAAGAATTTGATGTTCTGAAGGTCACAAAAACTATAATACAGGCGGTTACTGGAA

ATCCTTGTAAATTGAATGATCTGAATCTACTTCATCTTGAATTGATGGACAAGCTGAAAGATAAAAAATTCCTAATTG

TTTTGGATGATGTTTGGACAGAGGATTATGTTGATTGGAGTCTTCTTAAGAAACCATTTCAATGTGGGATTATTAGGA

GAAGTAAAATTCTTCTAACAACCCGCAGTGAAAAGACAGCCTCCGTAGTCCAAACGGTTCAAACCTATCATCTAAA

CCAATTGTCGAATGAAGATTGTTGGTCAGTGTTTGCGAACCATGCGTGTCTTTCCTTGGAATCGAACGAGAACACAA

-continued

CACTAGAAAAAATTGGAAAGGAGATTGTTAAAAAGTGCGATGGACTGCCTTTAGCAGCACAGTCCCTTGGAGGCAT

GTTGAGAAGAAAGCATGACATTGGGGATTGGTATAATATTCTGAATAGTGACATTTGGGAACTTTCTGAAAGTGAGT

GTAAAGTTATTCCAGCACTGAGACTTAGTTATCATTATCTCCCTCCACATTTAAAACGGTGCTTTGTTTATTGTTCGTT

GTATCCCCAAGATTACGAATTTGATAAAAATGAATTAATCTTGTTGTGGATGGCTGAAGATCTTTTGAAGAAACCAA

GGAAAGGTAGGACTTTAGAAGAGGTTGGTCATGAGTATTTTGATGATTTGGTTTCGAGATCATTTTTCCAACGTTCAA

GTACAAATAGAAGTAGTTGGCCTTATGGTGAATGTTTTGTGATGCATGACCTCATGCATGATCTAGCCAAATCACTC

GGTGGAGATTTTTATTTTAGATCAGAAGAACTTGGGAAAGAAACAAAGATCAATACTAAGACTCGTCATTTGTCATT

TACCAAATTCAATTCTTCAGTCTTGGACAACTTTGATGTTGTTGGTAGAGCAAAATTTCTGAGAACTTTCTTGTCCAT

TATCAATTTTGAAGCTGCTCCATTCAACAACGAGGAGGCACAATGTATCATTGTGTCGAAGCTTATGTACTTGAGAG

TTTTATCATTTTGTGACTTCCAAAGTTTGGATTCTTTGCCTGATTCAATAGGTAAATTGATCCATCTGCGCTATTTAGA

TCTTTCTCATTCAAGTGTAGAAACACTGCCAAAGTCATTGTGTAATTTATACAATCTGCAAACTTTGAAGTTGTGTAG

TTGCAGAAAGCTGACTAAGTTGCCTAGTGACATGTGCAATCTTGTTAACTTGCGTCATCTTGAGATACGTGAAACTC

CTATAGAAGAGATGCCGAGAGGAATGAGTAAATTAAATCATCTACAACATCTGGATTTCTTTGTTGTGGGCAAGCAC

AAAGAGAATGGGATCAAAGAATTGGGAGGACTTTCAAATCTTCGTGGTCGACTTAAAATTAGGAACTTGGAGAATG

TTTCCCAAAGTGATGAAGCGTCGGAGGCAAGGATGATGGATAAAAAACACATTAATAGTTTATGGTTGGAATGGTCT

AGATGTAATAACAACAGTACCAACTTCCAACTAGAAATAGATGTGCTTTGCAAGTTACAGCCTCACTTTAACATTGA

ATCGTTGAGAATAAAAGGCTATAAAGGAACCAGATTTCCAGATTGGATGGGAAATTCTTCCTACTGCAATATGATGA

GTCTAAAATTGCGTGATTGTGACAACTGTAGTATGCTTCCTTCACTTGGACAACTACCTTCTCTCAAGGTCCTTAAGA

TTGCACGATTGAATAGGCTGAAGACTATTGATGCAGGTTTTTACAAGAACGAAGATTGTCGTTCTGGGACGCCCTTT

CCCTCCCTTGAATCTCTGGCCATTCATCAAATGCCTTGTTGGGAGGTGTGGAGTTCCTTCGATTCAGAAGCTTTTCCT

GTGCTTGAAATTCTTGAAATACGTGACTGCCCCAAACTAGAGGGAAGTTTGCCGAATCACCTTCCTGCTCTGAAAAC

ACTTACAATTAGAAATTGTGAGCTGCTGGCTCTTCTCTCCCAACGGCTCCCGCCATTCAAAGTTTGGAGATACGTA

AAAGCAATAAAGTAGCACTGCATGCGTTTCCTCTCTTGGTAGAAACTATAAAAGTAGAAGGAAGCCCAATGGTGGA

GTCCATGATGGAGGCCATCACAAACATCCAACCAACTTGTCTCCGGTCTTTAACATTAAGGGATTGCTCGTCAGCCG

TGTCATTTCCGGGTGGTCGTTTACCTGAATCACTGAAGAGTCTGTATATCTCGGATCTTAAAAAACTGGAATTCCCGA

CGCAACACAAACATGAGTTACTGGAAACACTGTCAATAGAAAGCAGTTGTGATTCACTCACATCTCTTCCATTGGTT

ACCTTTCCAAATCTCAGAGATCTTGAAATCAGAAACTGTGAAAATATGGAATCTCTTTTGGTATCATTCTGGAGAGA

AGGATTGCCTGCGCCCAACTTGATTACTTTCCAAGTGTGGGGCTCTGACAAGTTGAAGTCGTTGCCTGATGAGATGA

GTACTCTTCTCCCAAAGTTAGAACGTCTCCTCATATCCAACTGCCCAGAAATTGAGTCGTTTCCAAAACGGGGTATG

CCACCTAACCTGAGAATAGTTTGGATTTTCAATTGTGAGAAACTACTGAGCAGCCTAGCATGGCCATCCATGGGCAT

GCTTACTCATCTCTATGTTGGGGGTCGATGTGATGGCATCAAGTCCTTCCCTAAGGAGGGTTTGCTGCCTCCCTCCCT

TACGTATCTGTATCTAAGTGGATTCTCAAATCTGGAGATGTTGGACTGCACGGGGCTTCTCCATCTCACATCCCTGCA

ACAATTAACCATAGACGGATGTCCTTTGCTGGAAAATATGGTGGGAGAAAGGCTTCCTGACTCTCTAATAAAATTAA

CCATAAAGAGTTGTCCTTTGCTGAAAAAACGATGCCGGAAGAAGCACCCTCAAATTTGGCCTAAAATTTCCCACATC

CCTGGCATTAAGGTTGACAATAGATGGATTTAGCCACCAAGGAGGACCAACAGGTATCTTCTAAGTCTAACCAACTA

GAAAACTAGTTCTGTCAAGGATATGTTTCATTTCATGTCTTTCTCCTTTTACGTTTTACTAAATCCAATTCATTCTGAA

ATGGAAATTGACCTTGTATATATGTTACTGAATCTACAGAGAATCAACAAATCATCAAAGGCAACGTGGAAATTGAC

CTTGTATATATGTTTCGAAGAAGTAACGATACAGGTACTAAGTAACAACATTGATAAATACTTAAATATAATGATTC

TCCGGAAAAAATGTTACACATCAGTATTGTTATATTCTAACTTAATTTCTCCTTAAGATTATTGAGGCCAGAGTGAAAA

TGACCGTGGGAAACTTATTTTTGTTTTTCAGATATGGTTGATTGGCCCGGAGAAACTGTACCTACCCATGAATCTAAG

-continued

TTCAAATTTGAACTAGTGCTAAATGTAACTTTTAATTTAATTGACGTCAAATTGACACTTTCTCAATAGCTAAATTTTT

ATTTGTGAGGTTTTTTGTTAGGTACAATGTGAAGGATGAAAAGGTGTACCAAGTGAACTTTAGAAGGATTGGATGAT

TTCAGCTTATCTCTTATCTCCTGTCCTATAAATTAATAGTGGTATGATTATTCTAAAAATATGATAGATATGTAGATA

CGTAAGAATTGATAAAAGCATAATAAATATACAATTGCAATTCGGTAAATTGAAGAACATACATACTTCTTAGACAT

TGCTAAAAACAAAATCAAAAAATTGTAGATCATTTTTTCCTATTGTTCACAAATAAGAATGGTACTATCAATGATCA

ATCTCATTTCTTTCTTGAAATTATCTATAAACAAAACAATTTTCATATTTGGTTCATCAAGAAACAATACTTTTTATAT

TTCTATATTATATTTACTTCTATGTTACATGTCACTATATTTGATTATCATAATTTTTTTTAAAAGAATTGGTCACTTT

ACATATATGTACCAGTGAAATATATCAATATATTGGTATCGGATATAGATGCATGAAGCAAATTAAAGTATCAGTAC

TTTGTAGCAAAACACATTCTTCAAATCATGACATGAGGTAAAAAAATATGATGATATTTTTGTAAGTATTGGAAAAA

AAAAAAAAAGTAAAGCTTCTGAAATCAAAGAGACACTAATTTTCCACAACATCCTTCAATTGGGCCCAAGCTTCCTT

TCCTATTGACAAATAACTGGTTGTTAGTGCCAGCTTTTTCTTTTTTCTAGTTTTCCATTGATGGTTAAAAGCTAATATG

AACCTGTCACTCCTTAAAATTTCCACCAAAGTTTGGTAAATAAATATATAGGAGAGTGAATAATGCAAGCCTTGCAT

TCTATCTCTAAGTTACTAGGTATATGAAACAGGTATGGGTATGGTTTTAGAAGGTATGTGGTTCATCACTATTTATAT

TTTTACTACAAGAACCAGGTAAACTTTATTATGGTACAGTAAATTTAGTGTGAGGTTGTAACTACGTTATATCCATCT

AACTTAGCACGATAATTAAATTTAAAAGCAAAAAGATAAGAAAAAGGCCAATCTAACAATTGTTACCTCTCTTGCAT

GAAAAAATCAGAAACAAAAGCCCCACTCTTTCCTCCATGGTGCCTGTAATTAACAAGCACTTCAAAAATCAATGTTA

ATTAATTAATTTCCATAAGAAAAAAAAAGACAGAAGCTAATGAAATTTAAGGGGTACAACAAAGATTTGTAGAACGA

TCATTAATATTAGTGCAACACATCATGATGAAGTGCATGACATAATAATAATGTGAAACCAATCATGATAAGAACAG

AAAATAAATCAGTGCAATTACATGATTAGAAAATAAAGAGGCGATATATCATATTCCTATTGATCAGACAATATGAC

AACGTGTTAAACAAATGTGTCAGGTGCAATAATGAGGGGATAGAGAAGAGAAGGATGATAAAGAATGTGGTTATGA

CTTCTACAAAGTCGAATTATTTACTTTTTTAATTTTTTATATTTTCCTTTTCACTTTTCTAATAGTTGTCCGATTAAGAG

GAGTTTATAGAGTAGATTAAATTGGTTTTGAAAAAGAGAAATATCATCTTATACAATTTTTGGTTTTCTTAATTCATT

GTTCAATTGATGTAGTTAAAATTTAAATATGATTTAATAAGTTTGGATTGATCTCGATCTTAAGTTTTAATTTTAATT

CTATTTTTTCAAAAAAAAAATATTAAAGATATATAATAACTGTGATACAAAGTAATTTAAAATATTTTACCAAAAAA

TGTAATTTAAAATATCACATATATATAAATCATTTTAAAGCTAATAGTAATATTTTCTAAAAAGAAGCTAAAAGTATA

TCTCTGTTATACAAGTTGATAATTATATTTATATATACTTGAATAGTTACTGAATATTATATTTAATTAAATTTACTTT

TCATAAATAATTTTTAAGTAATGTAATAATTTTTATATATATATATATATATATATATATATATATATATAATAAATAAAA

ATATAAACATCAATGATATCATAAAATTTTGGTAATAATAATTTTTAAAAAAAAATTGTGAATTAACTAACCTTTCAG

GTTCTAGAGTAATTTATTAATCCAAATTGCCTTGAAGCATATTCCCATGCAAGTCAAGTTGAGGGACTTGATGGAGG

CCATTTCTGAAATAGAGTTAGGAGAAGTTATTTTCAGCCAACGAGAGATTCTGCAAGCTCCCTAATTTACCAATTCC

CAATGGCAAGGATGAGGAAAAGAGTTTATAAGAGATATCCAAGAATTCAAGGCTTTTGAAATCAGCAATGTTGTCA

GGTAGTGTTCCTCATATGGCAAGGATGAGGAGACTTTATTTCATGTAAAAAATATTTTCCTAGGAGTATATATATGAT

ATATGATTATGTTGGGTCATATTTATGGTATCTCAAGGTTTCAATTGACAGTTTTGGCTATCTCGGAAATTTTCCTTGT

ACCAAAATATTAACAATTGAAACATGTTTCAAATCCAGTTACTTTTGGTACCATAGAATTGAAATTAATTTATTTCAA

ATACATTGTATTCTTAATATATTAAATATGTTAATTTGTTATTTTTTTTAAAAAATAATCATTAGAAACAAGTTCCGGT

ATAGGAGGCATACTTAGTGTTTAGGCTAAGGAATAATGCCACCGGGTTCAGGAACAAGCCTGTTGAGGTGTCCCTTA

ACGTTCCGTGACATCCCCACTCTTGCATGGACATTCTGTGCAGAGAAACGATGGGTGGATGGAGGTAAGATTGGGTG

AGTTCTATAATAGTCACTGATGAGAACCCCAAGAGCAGCATTGAAGTTCGAGGAATCCAAATAAGACCAGCGTAAA

TTATCAATTTCATCTCTTAAATAGTCACTAAAATAAAATATAAATTAATTCTTTCAAGTATTGAAACATTCTTCAAAT

TAATCCTATACATTGATAAAATATTTCAATGTATATATGCATTAATGGATATTTAACACTTTAGAAATTACTTATAT

-continued

ATGATTTTGTTATTTTAAGGACTATTTATAAGAAAGAGTAATACTCTAGATATCAAATTGGTAGTTAATTTAATTACT
CTTGAAATAAGCATGCTCAATTTATAATATGTTGTTTTGTTGGCAATTAAATAAGCACACCCTCTCTAGAATGGTGTG
TATGTACTTTTCTGTATATGTTGTTTTGTTTGTATACTTTTGCTTGCATAGATCCCAAAACAATTGGGTGATTTTCATT
CTTCTATAAATTTTCTTATAAATATTTAAGAAATTTTTGCTAACACAAGACTGGTGATATGATGTTAAGATTGACATA
ACAAGGACGTGAGAGTTCAATTTTTCACATGCCATGTCACCCATCATAGTACCTTGTTGGCATGTATTAAGTCAACA
ACAAACTTCCATTTTAACCATATCTTTGATCACCGCAAAAAATTATTAAATTTACTATTAAATTGTTTATATTTATTTT
TCTTTATTGTTGGGCTGAGATTTTTTTAGTTACTAAAATTATAAAAGTTTTTTTAATCTCTGAATTTTGATAAATTGTTC
TTTTTAGTTTCTGATTTAATAAATTAATATTTTATAATAATTTTAAAATGAAAAATTCAATGGCTAAAAAATAAAAAT
CAATTAATGGTTGCTAAAACCTAAAGGATGTTGCTAATCAGTGCCCTAAGGCATTAGTTAATAAATTAAAATAAAAA
AATATTTATTATGAAAATCATAAGAGTATGTAAAAAAAATCATAAATAATACTATTTTATATATTTCAATAAAAAAAT
TATTATTTTAGTTCTTTATAACCAATTAATACCTTAAAAACACTAGTTAACATTTACCATAATTAAATTAACTAATTTT
GAAATAAACTTCAATTATTCAATTATGTCTTAATAAGCTTGATTTTTCCCTTACTACTGCAAGTTTGCATCCTTTATTA
AAGTGAAGTGATGAAATGTTGTCTGCCATTTACGAATATCACTGAAATTAAAGTTGTTTTCTAGTTGAATTTATAATA
AGTTTTTTTAATTGATAAATTTTAATCGTTATTTTGTGAGTTTTTGTTAGTATAAGGAAGTAAAGTCACAAATTTTCTT
TTCTTTCATAATTTTTTAACCATCCCATCAATATTATATCTCCATTTACAATAAGTTAATAACTAGCAAGATACCCAT
ACATTTACGCAGATCGCTCTCCTTTTTTACGCATATTCAAAATACACTTGCTTAAAAAAGATAATTAGCTATTTAGTA
TTTATATTCAATAAACATGAAAAAAGGATTAGAATATTCAAGCAAAAAAAAAAATCAAAATCCTAATTTTTAGGCTAT
TTAAATCATTGTCTTCTATTATTTGAAAATTGAAACTATTATTCATATTTTACCTGTTTTATCTTCATAAATTCTATTT
TAATATATTTATTATGTATTTATGTAAAAAAATCAACACTATTAAAATTAATTTAATTTGTGATATTATTCAGTATTTA
ATATTTTGTTATAAAAATATATTTAATAAATTAATATTAAAATATTTCTTATATAATTATGAAAAAATGATATTTAAA
CTTATTTTATAAATATTAGTTAATAAAATTTCCATATATGAAGTTATTAAAAAAAGAGACAAAATAATATTTTGTAAT
AAACATATTACCTAATTAGATTTAAATTAATTAATAGTATAAAAATTTCAACTACATAACATAAATTATTCAAAAAAT
ATTTCATTCATAAAATTATTTTATACGGTTTCTAAGTAAAATTGATTTTATAGGATTTCAAATTTTTAAAAAGATATCG
TGGATTCTTTAATATGTTGTTATGTTAAATATTCTTAAAGAAAAAGCTTTGTCACCCATAATAATTGGCCTGTAATGA
CGTTAAACACGTGATTGTTTTTCATGAATGATATTTTTGGTCTCTATCATAAAAAATATATATTAATTAAATGTATTAT
TGAGTAAGTATTTTAAAAGTATTGTATTAAAAATTATATTTAATAATTAAATTTTAGTAGTTATTATATATTATGTAGA
AGTGATTATAAAGTAAAAATGGGTTTTCAAATTAAAAAAAAAATATTATTTTTACTCTTTGATATACAATTGTGTTAA
CTACTAGGCGAAAGAACTGTGTCATTTGTAATAATTTTGAGTAGGATTATTTCTCATCAATGATTATTAAGATCCCTG
TCATGATTAAAATGATTTTAATTTATGATATTATTAAGTTTTTGATATGAATTTGTGTGAAATACTTGAAGAAAGAGC
ATATTCAGTAAGTAACCTAAAACTATTTTGTAATAAAAATACATTTTATAAATTGATTTTAATATTTTTATTACTACAT
ATTATGTAAAAATTAAAATTAATATAATTTATGATTTTATTGAGTAAGTAATTTAAAATTATATTGTGATAAAAATAT
ATTTAATAAAATGTTATATAATTATGTAAGAATGATTTCCAAATAAAAATAATATTATAAGATTTGAAAGTAAAAAA
AAAAATACTATTTCAGTTTTTTTTATGTGTAGTTGTGTTAACTACTTGGATAAAAAAAATATTGTGGTCTATAATAGT
CTTTGGCAAGATTTTCTTGTCACTAATCATATTTGTAATCTCTAGCATAACTAAAATTATTATAATATATGATATTATT
AAGTCTTTTGGTATGTAGTTTTATAAAATATTGGAAGAAATAGTTTTGTTGCATATAATAATCCAATTTCGAGTAGGA
TTTTTTCTTATGAATGATATTTATGATTTCTACTACAAAAATATTTAAACTAATTAAGTTTATGAGATTATTGACGAAA
TGATTTAAAATTAGTTTTAATAAAAATATATTTAATTAATTAATTTTTAACATAGAGTCAAAACATTATTTTGTAATAA
ATTTGTTAACTAATTAAAATTAAATTTATTTATAGTATAAAAATTTCAACCTTATAATATAAATATTAATGAATAAAA
TATTTATTTATAAGATTATTTAATTTTATTTTATATGATTTCTAATTAAAACTAATTTTATAAAATTTCGAATTAAAAA
TAAATTGTTGAGTCTTTAATATGCAATTGTTTTAATTACTCGCGAAAGAGTTTTTTTTTTCCTATAATGGTTGGCCCAT

-continued

AAGAAGAATTATTTTTAGTCATTATCCCAAAGAGAATAAAACTAATTTAATTTATGCTATTTCTTAGTAAATAATTTA

ATTTTTTTTAAAATAAAAATACTAAGTGACTAATCTTCCTCAAGAATTCTGAGTGCACATAATTTGACTATTCCCCTC

CCAACCCAATTTATTTCATACACAAGGATCAACGGGGACTAATATATTAATTTTAATATATCTATTATATATTTACTT

AAAATGATTTTATAGAATTTAAAAATAAAAATAATTATTATTGAATTTTTGGTTTGCATTTGTGTTAACTACTCAGGG

TAGGAACATTGACGTCCATAATGACATTGAGTAAGATTGTATCCCATCAATGATATTTGTGATCTCTATCATATTTAA

AATTATTTAAATTTATGATATTGTTAAATCTTTAATATGTACTTTTATGTGTGTTTCGTTGCATTTGCACATAAGATCT

CTAGTAGGATTATTTTACTTGAATCATCCAAGGTTGTTAAACTCATGTTTTAAATCGTAGAATTGTATGATTTTACGA

TTCCACTAAGCTTCAGCGAGTTAAATCGAAAGCAGAATTGAAAACGGAATAGACTCATCTGATTTAGCGCAAACTTG

GGCGAGTTTGGGTAGACTCGCGAGTCTGCTACGAGTATGTGGATTTACGAAAACCCGAAACGGTGTCGTGTTGTAGC

TACTTATTTGAGTAGACTTTGTCTACCTTGTTCGAGTTATGCAAAGTGCAAAATTGTTTGGTTCATGCTTCTTGGCTTC

TTGCTGTGATGCAGTCGGTGCTAGAGTGCTACGGTGGGGTGCGACGGTGAAAGGAGGTTTTCGGTGTTGGAGTGCGA

CTGTGCAAGTGTGTGACACAGTGCTTCTGGATCTTTTGTTGGAAGGAGGTTTTCAGTGAAAGGAGGTTTTCGATATAT

GGGATCAAGGTGATTTGTTGCGAACAAAAGCTAAACTTCAAATTGCACAGGGCCAGTTAAGGAACAAAAGCTATAC

TGATATACGCAGTTGCTAGTTGTTCTTCAAATTCAGAGTAAAGGTTTTAATTTGGTTCTGGGAAGAAGCTATACAAGG

TTTGTTGTTGTAATAACTTATGCTGATTGAATATTTCTGAACCATGGGCCTTTATTCCTGTTATTTACTGTTAGAATTG

GATGAATGCAGTCTCATGAACCTTTTGAATTTATTAGATTTTTCAAGAAATTTGTGATCATGGGTTTGTTAGAAAAAA

GGAAGTGTCCTGATAGTTTGTACCTTAGAAAGTGAGAATATTGATATATAGGAAAGTAATAGTGAGAGTATTGAAGA

TTTGATCACCATTTTATTTGGTTTGAAATGGAGGCATTTCGTGAAAAAGTAGAGTGCAGAATGCATAGAGTTCCTCA

GAATTTCGCATGTGTTGATGAAGCTTTTTGAAGCATGGTACACCTTTAAGGGCATACTACTGTTGGGTTCATATATTT

TTTGGTTTAATGAGAGAATTGAAGATTTGATCACCATTTTATTTGGTTTGAAATGGAGGCATTTCGTGAAAAAGTAGA

GTGCAGAATGCATAGAGTTCCTCAGAATTTCTAACATACTACTGTTGGGTACACCTTGAAGCATATTCCCATGCAAG

TCAAGTTGAGGGACTTGATGGAGGCCATCTCTGAAATAGAGTCAGGAGAAGTTATTTTCAGCCAACGAGAGATTCTG

CAAGCTCCCTAATTTACCAATTCCCAATGGCAAGGATGAGGAAAAGAGTTTATAAGAGATATCCAAGAATTCAAGG

CTTTTGAAATCAGCAATGTTGTCAGGTAGTGTTCCTCATATGGAATTGTTGGACAAGGAGGGTTTTCACTACTGACAA

ACTGCTAACTCAGTTGGAGAATGTTGTGTAAGTGTTAATGCAAAGGACAATACCGAAATGCATGAAAAGATCATCAT

CTCATAACAGACTCTTTCACATACGACCGACCACCTCAACTGCAATGGCATATTTTGGTGAACGAAATTGTTCTGAC

TCACGTAGATTCAAAGTGAATATTCATAAATCAGGCATTTTCTTTGCTTTGTGACAATGTCACTAAACCTTCAATTAG

TTGATCTTGTTCTAGCTCTATAGGGTAATAAAAGTATATCAATGTCTGCAAAATACATCAATAAGATCAAGACACCA

AAATATATATATGTGCTTGAATTATTTATAAACTTTTATTTTGATTCCGGGTTACAACTTATCTTAAAATATTTTCTTT

TTTCTCTGTTTCTTCTTTCAAGTTTTTAATTTAACTTCCTGGGTAATCTAGATTCCATAAAATACTTCTGGAAATGCAG

ATATGATCTTGTTTTTTTTTTTTGTATTTTACTATTCTATATATTTTATATTAGTGTTGTTTATTTTCTTAAAATTATCAT

ACATAATTATATATGCTATATACTTGTTGATAGGGAAGAAGATAGAAGCTGGTTTTCAAGGACCAGGGCCTCCACGG

AGAGAAGAATGAGAAGAATAAGGGAAGGAACAATTGTATATTCCATTGATTGATGTTGTTATTACATAGTATTATTT

ATACTGATTTCTCAATAATCGAATTTGTCTTTTTGTGCTACAGAATATCAGGAAATTGTTAAGTTTGTCTATTCCTACC

CGACCAGCATCATTCTTCCAGATATGATGCACCTGCTTGTTTCACACCTAATCCTTGAGGTAAGTGGGTCTTGTAATT

GCTCTCTTGGTCTTGTTTTCTAATTGCACCCCCTTGCTTCTGTTGCTTGCTTGCTGCAAGTTCCCACTGATTCAAATTC

CAACAGTTCTGCAAATAAAATTGAAGAAGAAGCTAGAGGTGGGAAATACTCAAGTCATTCTCTTGAAAAAGTTGCT

GCAATGATATGCAACAAAATATCACTATACGGAGTCAAGGTAATTATTGTGTTCACATGAACATTTCTTCCATGAAA

ATATATATTTTTTTACTTTGTAATCTCTTTATAGTATGCATGGAAAATTAATTTTCTGATTTTTTTCTCTGTAGTGTTAT

ATATTATTTTTAATCACATTTTCTTATTTATTAGTTTGTTTCTTATTTGACATCATGTAAATTTGGAGATTTGGGTTAGA

-continued

AATGTTTTTGGAATTTTCCTGGTTAGAACTTGATAGGTCCATAATGAAGGTATATAAAAGGATAGGGAAAAGAGGGG

GTGGGGAATAGAAAAAGAAAGGACAAATGGGCCTCAGAAACAAGACATGCTTGTGTATGACAGCAGAAAGAATCA

GCCGTACAAGTTGCACTAGCTGAAGTGGAAAAGGAACATAGGTTGGCATAATGGAATGGATAGCATTTGATCTTTAA

TAAATTTTTGCTTTGTAATAGGTTCCTAATATTTAAAAAGTTTTGTTTGAAATACTTATCATTAGTCAAAATCTGTTAT

TTGCTCACACGATCGTTAACCAGCCACACAGACATGTCATGTGTGATTTTTGTCTGACTGAGATTAGGATTAATGATA

AGAAACTATAGTCAAAATCCCTTGGGCATAAAAGAATCATTCTTCAGCAAATAACGGATTTTGACTAATGATAAGAA

ACTATAGTCAAAATCCCTTGGGCATCAAAAAATCATTCTTCAGCATTCCTCTACGTTTTCACACAACCCATTATAGTT

TCTTCTATACCTTTCTTATGGATTTGTCACTATGACTTCGTCACTCGTGAAGATCCAAGGTGAAGAGGTCCTCACCAA

CGATTTTTAGGATCTTGCAATCAATTTTACATTTTCAAATCAAACCAAGCCAACTCCCAACTCAAGAAATTCACATG

GATAAGGTTTCTAAGAGAACACATCAAAATAGTTTCATGGGTAGAAGAAGGTCAACAAAACCTTACCCTAAAATGC

GATTCCGCTCGGTCCATTGCATAGAGCACGAAAAAATGAGTGGGATAGCGATGTCTGAACTTGTCGTCGACCTTTCA

TAGTTGCGAGCTCTTTTTGCAAACCCTTGCTTTCATGGTTGTCTCTTCTTGTTCTCCCTTCTTAAAGGTCACCACCAAC

CCAGCCATCGGCCACCACTGGTGTTGCCAGTCGTGCCACTGCTCGTGCCAGCGCCAGCTACCACCAGTAACTTCCTT

CAACTCTCAAACCTCACTTCTCTCCCAGTCTCTCTCTCACACTTGGCCCTCAAACTCACTTGTGTGTCGTAGGTGAAG

AGAAGGAAATGATGAAAACAAAGAGGAGGGTTTTCTTTGGGGAAGGGGGGTCCATGAGTGATTTTTTAGAGAAGGA

GATTTGTTGTTGCCATGGGGAGCCATGGTTCAAGAGAAGAAAAAAAGAAAATGGGTTAGAATTATTGTTGTGTTGCT

GCCATGGGGTTTCAAGGGAGGTTTGGGGGGTTTTGGAGACACAATAGCGGTGGTGTGGAGCTAGTGGAGGAGTTGG

TTGGGGACTGGTGGGGGTGGTTTGGAGGATTCGGGGACTTAATGATGTCGTTTTTTTACTTTTTTCTATAAAAAAATA

AAAAATCTTACGTGATCGGTTATCGATCACATATGAAGATAATGGATTTCGACTAACGGCAGGAACTTCGAACAAAG

CTTTTTAAATATTAGGGACCTATCACAAAGCAAAAATTTATTAGGGACCAAATGCAAAAAATGAGTATTTATCAGAG

ACCAAAAATATATTTAAACCATTACCTAATTGCAACTCACTATGTGATAAGTTTGTTGACTTTTAAAATAATTATTTT

AAAGTAATTCAAACAATAATTTATAATAGTGTAAAATCATTTTACATCATCAATACATAAGTATTAAACTCGATATCT

CTCTCTATATATTTTCTGTTCGAGATTGATTGAAATTATCTTATTTGCTTAACATATTAAAATGCGTCATTTTTAATGA

TATTATTGGTCTATAGTTTTTATGTAATACATTTAATAATGTTTAGAAATATTTGTATATAAATAACTTTTATCTATTTT

TTCACCAGAGCCTATGAAATGTAAGCACAGGTTTGTTAATGAGTAGCACAACATGGACAGTTTGTCAAAGGCCCAAT

AGCATCTTTAATGGGATTCTTGAACTCAAGAACCCTATCCACTAGATCTACTATTATTCTTATTAAGAGTTTTTTAAG

ATGGAGATTGGGTTCTAGGAAAAGAACTACTATTTTTTTCAAAAATATTATTTTTTTCTTGTGCTAGTAAAATCTAATAA

TCCAAATTGGATTCTACTATTAGAATAACAAATGATAGAAGTTCTTGCATCCTATATAACATCATGGGACTCACAAA

AAATAATCCAAGAACCTAAAATGGATTCTTGACAAAAATGTTCTAAGAATCTCAATATTTTCCCACTTAAGAAATA

TAACTATCAAATCAATATAATATGAAACGAGTTCAATCTTTATTGATTCACTTGACGCAAGCTATATGCACAACTGA

CATAATAGATTTTAATTCTAAATAACATGCAATAAAAATATAACAAACCTGTTCCGGAAAAAGCCTCCTCAAAATGA

AGCACATTCAGTCCCCCCACAATTTTTACAAGTTGGGGTCTTTATGCTGCATCAAAATATTCCATCATATCCCGCAAA

TGTTTCGTGCTATTAAGTTTATGTTAGTTGTCCCTTCATGATGCATCACCAGCATATCATAAACAATCAGTTAATCCC

TTATTCTGCCGAAATAGTCGGATTATCGTCAATCCCCCTTAAGGTGGTCGTTGATCCCGCTTGGCAAGGCCCAACTT

TGAAAGTGAATTGACCTAAGCCTCTTTTATGGGCTTGATGCGTGATAGAAGATCGGAACATAATCCAATACATTCCA

ATCTGAACCAAAAGATAACCCCTTAGCTTCAAGCACACAGTGCGTAAAAGCTAAAGATGTAGAAGATCGGAACATG

ATCCGATCTAGACCAGAACAAAACCTAAAACCAAACTACTAACTGATCTATAATTTTTTATACATCATAAAACTAAA

AAAACAAAGCAAACTAAGCACATAATCTTACAATCCCTACTGAATTTACTAAAAGAGACACAGATAGTTGAGGTGG

GAAATGTTGCCAAACCAGAAATGAATTATCACGGGAAAGTATGGCTGATGTGGTTACAATTAGGAGTCTTAATTCAT

CTTAAAGCATTAATATTTTTTAACTTAACAAATATAATTAAAGAGAAGTAACGAATAAGATAATGATCTAAAATTCT

-continued

TGTATTGATTGAAAATAGCGTAAAAAGATGTTTCAAAGATAATGATACAAACTCTTTAAATGCAAATGGTTACATGC

ACAAAGCACGTATATATATATATATATATATATATATATATATATATATATATATATATGAATATATCTACGTACA

TTCATATATGTATGTATATGCAAACATATATACATGGATGCATATATATATATATGCACTAACAAACATATATACATC

TGGATAGAGAGAGGATCAGAATAGCAGGACAAAGACAAACTTGTATTTGTTGCTTCCATACTAGAATTGCATTTTCT

TCAGGGTTAGATGCATCAACTGTGTGGGAGGGAAATTTATTAACAGCGCTAAGTATTCTCCTAACCTTAAGCAGGAT

CTCCTTCTGGTCTCTTGCCATCTGAGCTTGCATGTCAATGATGAAAAACCTGACAAGCGAGTCCGCAAGTGCCTCAA

GTTGTTCCTGGTAACAAGCTTTGTCGCATTGACCGAAAAAACCAAGGTGACGTTGACCAAAAAATAGTCCTGACAAG

ATGTTGGTAAAAAAATATAATCGGTTGATATCGATCACAAACATCATTGACTAAGGTTAACAAAAAAATTTCTAACC

GACATTGATCAAAAAATAACTTCGACCAAGGTCGATCAAAAGAAACGTAACCGATTTCGGCCAACAGAAATATTTT

ATATGATAGCCTTTAGTTGCAAAAAGTGTGAACCAGGGGGTATTTTGACAGCCGTAAAACATATCTCATGGCAGTGG

TTGTTATATAAGGCAAAAAACCATGAACTTTCTTCTCTTGCTGGTGTTTGGAGCCACTTCAAATGTGATTGATGTTAG

AGAAGTTAACAGTGGCATTTTTTAGGACTGAAAGTTAACTTAGGAGAAACCATTTTTTTATGTATGTAATACGGTAAC

ACATGTACCTCTTGCAGAGATTGGGGAGAAATTGCAACTTTTCTTTTTACATTTTGCCTTAAAAAAAGTGTTCATATT

TATAAAAATAATTTTCTATTTAACTTGGATATTTTTTCTCATACTACTACACTAAGGTATATACAACCTAAGGCGTGT

TTCTTAATTTGGAGAGTGATGCTTGATTGATTGACTACCAACGAAGGATAATCTAAAAAGGAGAAACACCATTTATA

ATCCTCATGAGTGCTTATGTCCCTTTTGCCTTGAGGTAGATGAGTCGGTATCTCACTGTTTCTTCTCATGTCATAAAAT

TCTTGGTACTAATTTGGAGGCAATGTTACTCTTGGCTGCTGGCTGCATGTAAATGTGGTGTTGCCACAATGACCAGA

ATCACATTTTTGGCAAGATTCTGTATTCGTAAGTTCAAAGAAGGAGGCAGATGTATGGAGGGCGGTGTGGGCATCAG

AAATTTTGGTGTGTATGGAATGCTAGGAATGAGTGTATGCTAAGGAATTAATGGCTCTTTCAATGCTGAGAAAATTA

CGCAGAATATATTATTCTTTGCACGATCGTGGATTAATAAAAGCCAGAGTCCCTAATTTTAATTATTGTTTTACTTAA

TGATATATGGCACCTGGAGCTTGTTTCATGAAGAGACAATTTTGAATGAAATGTGAAGTTAATTTGATTCGGTGGTA

GCTGCTCTTCGAGTGGGATCATCCCAAATGCAACCGATGTTTATGTGCACGATGGTGGGGGCTGGTTAGTGATGCCG

CATCAATGTTGCATGGCTTTAGACATGATTTTAAATTGCAATTATGATTGCGTTGCATGCAACGAACCTAAAAATCTT

ACATTGTGGATAATTATGGAAAAATACAAACTGATGTGATCATAATTATAATTGTGATGTGATTACAGAGTCAAAAT

ACATTAGCGTTATGACTGCAATTATGGTTGCTGACTACATTTTAAAACCATGACTTTGGGTGTAATGGTCCATGTTCG

AAGCTAGCTATCTTTCTTTCTACTGTCACTGGTGTATATGTTTTTGGATCTTAGGTAATTTTGGTACCATTTAATACAA

ATCATTTTGTTGGAAAAAAAATACGGTAGCCTACATGCAATATACAAAATAAAATTGAATTACTATATATTATCATA

AATAGTAGAGTATAAGAAGTAAAGAAAATTCTAAAGATAAACATGCATTTAAAAACATATGAAAGAATTTTTTAACT

ATATATATAACATCTTTAATTAGCTTAATAGAAATGCGAAAGTACAATAAAAAAGCAAAAACATAATAGGCGTGAC

AAATCGGTTGCTTATATACAATAAAGACAATAAAGTTTGAAACTAAAACCTTATCCAGACTATCCAAATATCCCTAA

TTAATCATGAAAAAATTAGAACAGAAGACATTTAATAACTATAGCAACAGTAACAGCAGCAGCTATAGCTAATGGC

GCGATCACCGAATCGGAAAACTTTTCATCATTGAAGTATTCTATTTCACTAACCCTAAGCAAGATCTCAAGTTGATC

GCGTGCAATAAGAGCTGGCATTTCAATATTGAAAAACCTCTCAATTGAGTCTGCAAGATCTTTAATTTTAGTTTTCCA

CGGTAAGAATTCTTAGCCACAAAATTGTATTTCCCTATTTTTGAACACTTGTAAACAACCTCTTTGCTCTTCCTCAAT

AGTTGTATCAGTGGCTCAAGTTCCTGCTGTGAACGACCCAACATATTCCTGTACTTACCTATCTCCTGCCATGTTTAC

GCTACATATTTTCTAGAATGTTATTTGAATTTCATTAAAAATCATAAGAAGCAAGTTTGAATTTTTCAGTGAAATTTTT

ACTTAGGTTTAGTTAGACAAACCCTATTAAAGCTATATTGTTTTGCTTATCGGAACCAAACCAATTAGTTCGGTTTG

AATTTCTTAGTTAAATCAAGTCTGGCTTAAACCAAATCGAGCTAACCCTAGGTTAATTGTTTCAAAGGTCGGGTTGA

AGCTCTTTAAACTTGAGAATGTGTTCTACAAACCGAAGTACCTTATTATTTAAAGAATATCTAATATTTTTTTGTTTTT

ACATTATTGTTGAATCCATTTTATATGATTTTTTTTTTACAAAATATTAAACTTTATTTACTAAATAAGATTTATATAA

-continued

AATTCATGAAGGTAAAAGTAATATTTTTATCTTTTAATGTAAGGCTTGGTTTCACTTTCGTCCTTCAACTTTTTTTTAT

TTGATTTATTTCAGTGATCATTTAATATTTATGGATTCTTCCTTAAGGAATCTTGATATTTTCTATAGTTTTAATTGTT

CTTCGGTTATTTATTCGGAAATTGAGAGGGGATCATCACCTCCAAAGATTTCCTCGCTCCCATTAACAAAAATGTCTA

AACAATTACCTTCCTTCTAAAATTTTTGTGAAGTACCTCCACTAATTAAACTCAACATATCTCCCAAACTTCATTTT

CTTTGAAAACAATGTTGTCTAATTCAAGACGCTTTGATATAAAATATTTAGTCGCTAGAACGAGAAAAAAAAATTGAA

TAAAAAGAAGGGATTTTTTTCTTCTTAATGTACTTCATGCTACTTATTTGTTGGCAATCATTATTAATATATATTATCT

TATATGAGACAATTTTCAACATTTAAATGTTAATTTTGTAAGTATCTTGGTAGTATCCTTTTTTGATAAGGAATAGAT

ATTATTTTGAGATTATATTATGATGATGAATTGTCTCATAAAAACACGAGGCAAGCACTTGAAAGGAACAAATTCTC

TAATTTCTTAGTGGGTAGTGGGAGAGAGGAAGTAAACTTGCTTCAATATGCAAATGACGCTTGACGCACTCTTTACA

GGAGAAGCAACCATTTCTAAGGTGCTTACCATAAAAAGCATTTTGAGAGGCTTTGAACTTGTCTCGGGCCTCAAAAT

GAATTTCCATCAAGGCTTTTGTGGTGCCTTGGGAGTGGATATTGATACCTTGATGAATTATGCAAGCTTGTTGATTTA

CTTGAGACAAACTATATGCACAACTGACAAAATGGACTTTAATTCTAAATAGCAATAAAAAGATATATAATAAACCT

GTTTCAGAAAAGGCTTCCTCAAAATGGAGGCTACTTCAATCTAGTACGGTAGTTGACTTACTAAGTACGAAACAACA

AATTATTAAGTTGATAATTAATTAAACATGATTTTAAATACTTACATATTTATTCACATGTAACTATAAAGATTTAGT

AAGAGCATAAATAAAAAATGTGTTATAATATATAATTTTAAATTTAATATAATAAAAATGTGTTTGCAAAATAGAA

ATATAAATATAAAGCGTGACAACACATGTTTTTCGTTAATAATAATAATAATAATAATAATAATAATAATAATAATA

ATAATAATAATAATAATAATAATTACAAATGGGTTTTGACAAAATCATACCTGGCGAAAATATGCAGTTTAGTGACG

GAATTAATTTGTGATTCATGCAATACAATTTGTACCAATCATCATCATCATCATAATCTCTTTTTCGTTTTATTTATCA

ACGTTGCTACTTAGTACGAAAATTATTTGCACAAAATACAAACAGAATGATGCTATCTGTTATGAAAGGTAAATCCA

CACGAATTACACGAAATATAGAATGGACGGTTATGATTTTATAAAATGAATATCGATTAAAAAAATTTAAAAGGCAT

GTAAAAAGAGATTTACAGACATCAAACTTCGTGCGACTTTTACAAAATCCTCTTTCCTAACACAGCATTATATTTTCC

ATACACAAACCGTAAACTATAGATTCTAAAGGGTATACCTGACTTATTAACAACTTTTTAAAAACTAATATTCATTA

AAAATACCAAATAGGTTTTGACATAATCACACCTCGTTGCAGATTTGACAAAAAAGAATTCTACCAATTTATTTTTC

GTCAAATTGGTGTTAAAATTAAATATATGTGACTAGTCAAGTAGGTGATAACAAGTTGCAGCACTTGTATATATGAG

TGATGCAAAGGATTCGTGCAATTTATTTACGAAAATTATATATTGGCATGAAACACACGAACTGTAAACTATATATA

GTCACTAACTTGTATACGTACGAACTGTAACAATAAATTTTAAAATAAAATATTAATTACAAATATAAAATGGGTTTT

GACAAAATCGATCACACCTCGGGCAGATTTGACAAAAGATAATTCGCCACGAATTCTTTTTCGTCAATTATTTAACA

CAACCTTCCTTTTACGAATTGCACAAATCCACTTTTAAAATACAAGAAAATTTTGTTTTAAAAATTCAGCCAGCCGAC

ATAGAGGTGTATGCAGGTAAGTTTGGATTGAGTTTCATCATACCTATGACTTAAGAATGAGTTGATTTGAGTCATTTG

TATACGATTTTAATTAAATTATTGGGTTAAAATATTTAAATTTGTATGCTATTTATTAAATCCAATATTTATATAAGCT

AAAATTCTTATTAATTAGAATACTGAAAACATTACTTATAAATTAAATATTGTCAGATGCTGCGACTAAGTGAGGTG

GTGGAAAGATGTCAAGAGTTGAACTCTAATTTTTGAAAGAATAACAATGACACTCGGTACTTATTCAACTCTCTTGTT

ATGCACGAAACATATATTTAATAATAAATTCACGCGCGTATTTATAAAATTATATGAGAATTTTTTGTATAAAAATTT

AAACACATAAATTATATTAAATTAAAATGTTATGGTAATTTTAAAATATGAATGATAAAATGATTCAATTATTATACT

TTAATTTTTAAATAAAAATTGATTTTTATAATATTTAAAGTTTATAAATAATATTTTGAATAATTTTACATATAAATTA

ATTAAATTAAATGCAAAAAACTGAAATTAAATATTCTTAAAACTAATTAATTATTATATGAATCACTTTATATTAGT

AATTGCGAGCTGCTTGTCTCTTCTCTCCCAACGGCTCCCGCCATTCAAAGTTTGGAGATAATTAAAAGCAATAAAGT

AGCACTGCATTCGTTACCTCTCTTGGTAGAGACTATAGAAGTAGAAGGAAGCTCAAGGGTTTTTATTTTAAAAAATA

TATAAAAAATGAATTTAATAATTTTTTTAAATTAAAAAATAATAGGAGCAAAGAGAAGTTGGGTTCCCTAACCCCGA

CTTCTCTCTGCAAGCTAAAAAGGAGTGTTGTTTAGGAAACAATTTTGAGGCAGGTGTATTTTGAAAAAAAATTGAGGA

-continued

GAGAGCAAGTGTAGTGGAGTAAAAAAATCCTATAAGATTTTGTTTGATACTAAAAAGAAAAAAATAATTGTGATGA

GAAAAAATAAGTTAGAGGATAAATATCTTCAACACTTAAACAAACAAATAAAAAAGTTTTTCTAGAAAGTTCACTTA

AATCTATTTTCACTATTGATAAAAATTTATACCTGTTGATTTAAAATAAAATTATATTTTATAAAAATTATATTTATTA

AATATGATAGGAGAAAAATATTTTTACATATAGTAAAATATTTTCATTTGCTGGACTTAAATTTTCTTTATCTCTCAT

TTTAGTATTGTTGTTTGAGATGATCTCACTAAATATATTTTACTTGACTAATAATAAAAATTTTATATAGATAAGATTC

AAAGGATAATCACCAACCAAAAATTTTTATGGAAGTATTTATCAAATAATTACAATAGATATATAACATAAAAAAAG

AGTTGAATTGAATAATAATTTTTCATGCCAAATTACTTTAATCACTCTATATTATTATTATTATTATCATTATTATAAC

ATCTTCACAATATTCTTTATTTTATTAGTATCTATTATTTATTTTATTAATTTTATTTAATAAAAAATCACAAACTTTTC

TTTTTGCACACATCTTTAACGTACATATAAAGATATTCAAATCTTGAATTCATTAATATTATGTTTTTAGGGATCAATT

AGCATGTGTCCTTTCTTTAATTCTTTCTCTTTTAATTTGTTCAACATTTTTTTTGTCTTAATAATTTTTTAATCTCATTTT

TTTATTTTCCTCCTAACAAAATTTATTCTATATATAAGAATTAATAAAAATTTAAATCTTTTACCACTTGATTAAAAAA

CATAAATCATTATCAATTATTTTAAATTTATAAAATCATGATTCAGTATTAGATCTTTATAAAATACCATATCTCTATG

ACAATTTTAATGATTAGGTTGAAATATAAACTAACACGAATTTAAGTAAATATTTCACTATTTACTTTCACATTGAAA

AATTGATTTTAAATTTTAACTTTAGAAAAAAAATTCTAAGTTGAGGATCTTTACATAACTTTTGGATTTAACAAAAAA

ATTCATTTTCAATTTTACTATTAACTTATTTTTTAAATAAAAATATCCAAAACACATGTGCAAACTGCTTCAATACAA

CTTGTCTCACAGCATCAAAGCACAGGAACATAATTATGCACAGTACCCTTGCAGCCATCCACACATATCACCAAGA

AAAAAACACACACCACTGCTCCACACGGTTTGGAAAGCGAGAAAGCTGGCCATCACTAACTTTAATTATAGCATTTT

AGAAATATAATCCATTTTTTTAAAATTAACGGTAGAAATATCATCACTCTTTAAATCTCTTGAGTCTTTAGTTTAGAG

GAGCTAAATTTAAAATAGAAATATCAAGAAAGCAACATGTGGGGATCAAAAGTAAAGAGACTCCCAACGTGATAAG

TCACCCACCACCAATTCCCTTGCCTTTTGTCTTGCACAGCAGAACGAGTGAAGGTGAAGAGAGTTGACTTAAGCCAA

ATCTCATCACATCAGTTCATAGCAACCAATTCCCTTGCCTTTGTCTTTCTACTCTGATCATCTTTTGTTCTTGAGATAA

TGGCAGCAGCACTGGTCGGTGGTGCCTTCCTCTCTGCTTTTCTTGATGTGGTTTTCGACAGGCTGGCTTCACCTGAGT

TTGTTGACTTGATCCGTGGAAAGAAGCTTAGCAAGAAGTTGCTTCAAAAGTTGGAGACCACTCTCAGAGTGGTTGGA

GCTGTGCTTGATGATGCCGAGAAGAAACAGATCACAAACACCAATGTCAAACACTGGCTCAATGATCTCAAACATG

CTGTCTATGAAGCCGATGACTTACTCGACCATGTTTTCACCAAAGCTGCCACCCAAAACAAGGTAAGAGACTTGTTT

TCTCGCTTTTCCGATAGGAAGATCGTTAGTAAGTTGGAGGACATAGTTGTCACACTTGAGTCTCATTTAAAACTCAA

GGAGAGTCTTGATTTGAAAGAGAGTGCAGTGGAGAACTTGTCATGGAAAGCTCCATCAACATCTCTGGAAGATGGA

TCTCATATATATGGTAGGGAGAAAGATAAGGAGGCCATAATCAAGTTGTTGTCGGAGGATAACAGTGACGGTAGAG

AAGTGTCTGTGGTTCCTATTGTGGGCATGGGTGGGGTTGGAAAAACTACTTTGGCCCAATTGGTGTACAACGATGAG

AATTTGAAACAGATATTTGATTTTGATTTTAAGGCATGGGTTTGTGTTTCTCAAGAATTTGATGTTCTCAAGGTCACA

AAAACTATAATAGAGGCGGTGACTGGAAAGGCTTGTAAATTGAATGATCTGAATCTACTTCATCTTGAATTGATGGA

CAAGCTGAAAGATAAAAAATTCTTAATTGTTTTGGATGATGTTTGGACAGAGGATTATGTTGATTGGCGTCTTCTTAA

GAAACCATTTAACCGTGGGATTATTAGGAGAAGTAAAATTCTTCTAACAACCCGCAGTGAAAAAACAGCATCTGTA

GTCCAAACTGTTCACACCTATCATCTAAACCAATTGTCGAATGAAGATTGTTGGTCAGTGTTTGCGAACCATGCATG

TCTTTCCACGGAATCTAACGAGAACACAGCAACACTAGAAAAAATTGGAAAGGAGATTGTTAAAAAGTGCAACGGA

CTGCCTTTAGCAGCAGAGTCGCTTGGAGGCATGTTGAGAAGAAAGCATGACATTGGTGATTGGAATAATATTCTCAA

TAGTGACATTTGGGAACTTTCTGAAAGTGAGTGTAAAGTTATTCCAGCACTGAGACTTAGTTATCATTATCTCCCTCC

ACATTTAAAACGATGCTTTGTTTATTGTTCGTTGTATCCACAAGATTACGAATTTGAAAAAAATGAATTAATCTTGTT

GTGGATGGCTGAAGATCTTTTGAAGAAACCAAGGAAAGGTAGGACTTTAGAAGAGGTTGGTCATGAGTATTTTGATG

ATTTGGTTTCGAGATCGTTTTTCCAACGTTCAAGAACAAGTAGTTGGCCTCATCGCAAATGTTTTGTGATGCATGACC

-continued

TCATGCATGATCTAGCCACATCACTCGGTGGAGATTTTTATTTTAGATCAGAAGAACTTGGGAAAGAAACAAAGATC

AATACCAAGACTCGTCATTTGTCATTTGCCAAATTCAATTCTTCAGTCTTGGACAACTTTGATGTTATTGGTAGAGCA

AAATTTCTGAGAACCTTCTTGTCCATTATCAATTTTGAAGCTGCTCCATTCAACAATGAGGAGGCACAATGTATCATA

ATGTCGAAGCTTATGTACTTGAGAGTTTTATCATTTTGTGACTTCCAAAGTCTGGATTCTTTGCCTGATTCAATAGGT

AAATTGATCCATCTGCGCTATTTAGATCTCTCTTTTTCAAGAATAGAAACACTGCCAAAGTCATTGTGTAATTTGTAC

AATCTGCAAACTTTGAAGTTGTGTAGTTGCAGAAAGCTGACTAAGTTGCCCAGTGACATGCGCAATCTTGTTAACTT

GCGTCATCTTGGTATTGCTTATACTCCTATAAAAGAGATGCCGAGAGGAATGGGTAAATTAAATCATTTACAACATC

TGGATTTCTTTGTTGTGGGCAAGCACGAAGAGAATGGAATCAAAGAATTGGGAGGACTTTCAAATCTTCGTGGTCAG

CTTGAAATTAGGAAGTTGGAGAATGTTTCCCAAAGTGATGAAGCGTTGGAGGCAAGGATGATGGATAAAAAACACA

TTAATAGTTTACAGTTGGAATGGTCTGGATGTAACAACAACAGTACCAACTTCCAACTTGAAATAGATGTGCTTTGC

AAGTTACAGCCTCACTTTAACATTGAATCGTTGGAAATAAAAGGTTATGAAGGAACCAGATTTCCAGATTGGATGGG

AAATTCTTCCTACTGCAATATGATTAGTCTAAAATTGCGTGATTGTCACAACTGTAGTATGCTTCCTTCACTTGGACA

ACTACCTTCTCTCAAGGACCTTGGAATTGCACGATTGAATAGGCTGAAGACTATTGATGCAGGTTTCTACAAGAATG

AAGAATGTCGTTCTGGGACGTCCTTTCCCTCCCTTGAATCTCTGTCCATTGATGACATGCCTTGTTGGGAGGTGTGGA

GTTCCTTCGATTCAGAAGCTTTTCCTGTGCTTAACAGTCTTGAAATACGTGACTGCCCCAAACTAGAGGGAAGTTTGC

CGAATCACCTTCCTGCTCTGACAAAACTTGTGATTAGAAATTGCGAGCTGCTTGTCTCTTCTCTCCCAACGGCTCCCG

CCATTCAAAGTTTGGAGATATGTAAAAGCAATAAAGTAGCACTGCATGCGTTTCCTCTCTTGGTAGAAACTATAGAA

GTAGAAGGAAGCCCAATGGTGGAGTCCGTGATCGAGGCCATCACTAACATCCAACCAACTTGTCTCCGGTCTTTAAC

ATTAAGGGATTGTTCGTCAGCCGTGTCATTTCCGGGTGGTCGTTTACCTGAATCACTGAAGAGTCTGAGTATCAAGG

ATCTTAAAAAACTGGAATTCCCGACGCAACACAAACATGAGTTACTGGAAACACTGTCAATAGAAAGCAGTTGTGA

TTCACTCACATCTCTTCCATTGGTTACCTTTCCAAATCTCAGATATCTCAGCATCGAAAAGTGTGAAAATATGGAATA

TCTTTTGGTTTCAGGGGCAGAGTCATTTAAGAGTCTGTGTTATTTGTTAATTTACAAATGCCCCAACTTTGTATCATTC

TGGAGAGAAGGATTGCCTGCGCCCAACTTGATTACTTTCAGTGTTTGGGGCTCTGACAAGTTGAAGTCGTTGCCTGA

TGAGATGAGTACTCTTCTCCCAAAGTTAGAAGATCTCACCATATCCAACTGCCCAGAAATTGAGTCCTTTCCAAAAC

GGGGTATGCCACCTAACCTGAGAAGAGTTGAGATTGTCAATTGTGAGAAACTACTGAGCGGCCTAGCATGGCCATC

CATGGGCATGCTTACTCATCTCAATGTTGGGGGTCCATGTGATGGCATCAAGTCCTTCCCTAAAGAGGGTTTGCTGC

CTCCCTCCCTTACGTCTCTGTCTCTATATGACTTGTCAAATCTGGAGATGTTGGACTGCACGGGGCTTCTCCATCTCA

CATCCCTGCAACAATTACAAATTTTTGGATGTCCAAAGCTGGAGAATATGGCTGGAGAAAGTCTTCCTTTCTCTCTA

ATAAAATTAACCATGGTGGAATGTCCTTTGCTGGAAAAACGATGCCGCATGAAGCACCCTCAAATTTGGCCTAAAGT

TTCCCACATCCCTGGCATTAAGGTTGGCAATAGATGGATTTAGCCACCAAGGAGGACCAACAGGTATCTTCTAAGTC

TAACCAACTAGAAAACTATTTCTGTCAAGGATATCTTTCATTTCATGTCTTTCTACTTTTACGTTTTACTAAATCCAAT

TCATTCTGAAATGGAAATTGACCTTGTATATATGTTACTGAATCTACAGAGAATCAACAAATCATCAAAGGCAACGT

GGAAATGACCTTGTATATATGTTTCGAAGAAGTAACGATACAGGTACTAAGTAACAACATTGACAAATACTTAAAT

ATAATGATTCTCCGGAAAAATGTTACACATCAGTGTTGTTATATTCTAACTTAATTTCTCCTTAAGATTATTGAGGCC

AGAGTGAAAATGACCGTGGGAAACTTATTTTTGTTTTTCAGATATGGTTGATTTGGCCCGGAGAAACTGTACCTACCC

ATGAATCTAAGTTTCAAATTGAACTAGTGCTAAATGTAACTTTAATTTAATTGATGTCAAATTGACACTTTCTCAAT

AGCTGAATTTTTATTTGTGAGGTTTTTCGTTGGGTACAATGTGAAGGATGAAAAGGTGTACCAAGTGAACTTTAGAA

GGATTGGATGATTTCAGCTTATCTCTTATTCCCTGTCCTATAAATTAATAATGGTATGATTATTCTAAAAATATGATA

GATATGTAGATAAGTAAGAATTGATAAAAGCATAATAAATATACAATTGCAATTCGGTAAACTGAAGAACATACAT

ACTTCTTAGACATTGCTAAAAACAAAATCAAAAAATTGTAGATCATTTTTTTCCTATTGTTCACAAATAAGAATGGTA

-continued

CTATCAATGATCAATCTCATTTCTTTCTTGAAATTATCTATAAACAAAACAATTTTCATATTGGTTCATCAAGAAACA

ATACTTTTTATATTTCTATATTATACTTACTTCTATGTTACATGTCACTATATTTGATTATCATAATTTTTTTTTAAAGA

ATTGGTCACTTCACATATATGTATCAGATATATTGGTATCAGATATAGATGCATGAAGCAAATTAAAGTATCAGTAC

TTTGTAGCAAAACACATTCTTCAAATCATGACATGAGGTAAAAAAAAATAAGATGATATTTTTGTAAGTATTGGAAA

AAAAAAGAGTAAAGCTTCTGAAATCAAAGAGACACTAATTTTCCACAACATCCTTCAATTGGGCCCAAGCTTCCTTT

CCTATGGACAAATAACTGGTTGTTAGTGCCAGCCTTTTCTTTTTACCAGTTTTCCATTGATGGTTAAAAGCTATTATG

AACCTGTCACTCCTTAAAATTTCCACCAAAGTTTGGTAAATAAATATATAGGAGAGTGAATAATACAAGTCTTGCAT

TCTATCTCTAAGTTATTAGGTATATGAAACAGGTATGGGTATTTGGTTTTAGAAGGTATGTGGTTCATCACTATTTAT

ATTATTACTACAAGAACCAGGTAAACTTTATTATGGTACAGTAAGTTTGGTGTGAGTTGTAACTACGTTATATCCATC

TCACTTAGCACGATAATTAAATTTAAAAGCAAAAAGATAAGAAAAAGGCCAATCTAACAATTGTTACCTCTCTTGCA

TGACAAAATCAGAAACAAAAGTCCCACTCTTTCCTCCATGGTGCCTGTAATTAACAAGCACTTCAAAAACCAATGTT

AATTAATTAATTTCCATAAAAAAAAAAAAGGCAAAAGCCAATGAAATTTAAGGGGTACAACAAAGATTTGTAGAACG

ATCATTAATATTAGTGCAACGCACCATGATGAAGTGCATGACATAATAATAATGTGGAACCAATCATGATAAGAACA

GAAAATAAATCAATGCAATTGCATGATCAGAAAATAACGAGGCGATATATCATGTTCCTATTGATCAGACAATAGG

ACAACGTGTTAAAGAAATGTGTCAAGTGCAACAATGAGGGAACGGAGAAGAGAAGGATGATAAAGAATGTGGTTAT

GACTTCTACAAAGTCCAATTATTTACTTTTTTAATTTTTTATATTTTCCTTTTCACTTTCCTAATAGTTGTCGGATTAAA

AGGAGTTTATGGAGTAGATTAGATTGGTTTGAAAAAGAGAAATATCATCTGATACAATTTTTAGTTTTCTTAATTTA

TTGTTCAATTGATGTAGTTTAAAAAGTTGCACTAACTGAAGTGGAAAAGGAACATAGGTTGGCATAATGGAATGGAT

AGCATTTGATCTTTAATAAATTTTTGCTTTGTGATAGGTTCCTAATATTTAAAAAGTTTTGTTTGAAATACTTATCATT

AGTCAAAATCCGTTATTTGCTCACACGATCGTTAACCAGCCACACAGACATGTCATGTGTGATTTTTGTCTGACTGAG

ATTAGGACTAATGATAAGAAACTATAGTCAAAATCCTTTGGACATCAAAGAATCATTCTTCAGCAAATAACGGATTT

TGACTAATGATAAGAAACTATAGTCAAAATCCCTTGGGCATCAAAAAATCACTCTTCAGCATTCCTCTACGTTTTCA

CACAACCCACTATAGTTTCTTCTATACCTTTCTTATGGATTTGTCACTATGACTTCGTCACTCGTAAAGATCCAAGGT

GAAGAGGTCCTCACCAACGATTTTTAGGACCTTGCAATCAATTTTGCATTTTCAAATCAAACCAAGCCAATTCCCAA

CTCAAGAAATTCACATGGATAAGGTTTCTAAGAGAACACATCAAAATAGTTTCATGGGTAGAAGAAGGTCAACAAA

ACCTTACCCTAAAATGTGATTCCGCTCGGTCCATTGAATAGAGCACGAAAAAATGAGTGGGATAGCGATGTCTGAAC

TTGTCGTCGACCTTTCATAGTTGCGAGCTCTTTTTGCAAACCCTTGCTTTCATGGTTGTCTCTTCTTGTTCTCCCTTCTT

AAAGGTCACCACCAACCCAGCCATCAGCCACCACTGGTGCTGCCAGTCGTGCCACTGCTCGTGCCAGCGCCAGCTA

CCACCAGTAACTTCCTTCAACTCTCAAACCTCACTTCTCTCCCAGTCTCTCTCTCACACTTGGCCCTCCAACCCACTT

GTGTGTCGTAGGTGAAGAGAAGGAAATGATGAAAACAAAGAGGAGGGTTTTCTTTGGGGAAGGGGGGTCCATGAGT

GATTTTTGAGAGAAGGAGATTTGTTGTTGCCATGGGGAGCCATGGTTCAAGAGAAGAAAAAAAGAAAATGGGTTAG

AATTATTGTTGTGTTGCTGCCATGGGGTTTCAAGGGAGGTTTGGGGGGTTTTGGAGACATAATAGCGGTGGTGTGGA

GCTAGTGGAGGAGTTGGTTGAGGACTGGTGGGGGTGGTTTGGAGGATTCGGGGACTTAATGATGTCGTTTTTTTACTT

TTTTCTATAAAAAAATAAAAAATCTTACGTGATCGGTTAACGATCACATATGAAGATAATGGATTTCGACTAACGGT

AGGAACTTCGGACAAAGCTTTTTAAATATTAGGGACCCATCATAAAGCAAAAATTTATTAGGGACCAAATGTAAAA

AATGAGTATTTATCAGAGACCAAAAATATATTTAAACCATTACCTAATTGCAACTCACTATGTGATAAGTTTGTTGAC

TTTTAAAATAATTATTTTAAAGTAATTCAAACAATAATTTATAATAGTGTAAAATCATTTTACATCATCAATACATAA

GTATTAAACTCGATATCTCTCTCTATATATATTTTCTGTTCGAGATTGATTGAAATTATCTTATTTGCTTAACATATTA

AAATGCGTCATTTTTAATGATATTATTGGTCTATAGTTTTTATGTAATACATTTAATAATGTTTAGAAATATTTGTATA

TAAATAACTTTTATCTATTATTTCACCAGAGCCTATGAAATGTAAGCACAGGTTTGTTAATGAGTAGCACAACATGG

-continued

ACAGTTTGTCAAAGGCCCAATAGCATCTTTAATGGGATTCTTGAACTCAAGAACTCTATCCACTAGATCTACTATTAT

TCTTATTAAGAGTTTTTTAAGATGGAGATTGGGTTCTAGGAAAAGAACTCCTATTTTTTCAAAAATATTATTTTTTCTT

GTGCTAGTAAAATCTAATAATCCGAATTGGATTCTACTATTAGAATAAAAAATGATAGAAGTTCGTGCATCCTATAT

AACATCATGGGACTCACAAAAAATAATCCAAGAACCTAAAATGGATTCTTTGACCAAAAATGTTCTAAGAATCTCA

ATATTTTCCCACTTAAGAAATATAACTATCAAATCAATATAATATGAAATGAGTTCAATCTTTATTGATTCACTTGAC

GCAAGCTATATGCACAACTGACATAATAGATTTTAATTCTAAATAACATGCAATAAAAATATAACAAACCTGTTCCG

GAAAAAGCCTCCTCAAAAAGAAGCACATTCGGTCCCCCCACAATTTTTACAAGTCGGGGTCTTTATGCTGCATCAAA

ATATTCCATCATATCCCGCAAATGTTTCGTGCTATTAAGTTTATGTTAGTTGTCCCTTCATGATGCATCACCAGCATA

TCATAAACAATCAGTTAATCCCTTATTCTGCCGAAATAGTCGGATTATCGTCAATCCCCCTTAAGGTGGTCGTTTGAT

CCCGCTTGGCAAGGCCCAACTTTGAAAGTGAATTGACCTAAGCCTCTTTTATGGGCTTGATGCGTGATAGAAGATCG

GAACATAATCCAATACATTCCAATCTGAACCAAAACAAAACCTAAAACCAAACTACTAACTGATCTATAATTTTTTA

TACATCATAAAACTAAAAAAACAAAGCAAACTAAGCACATAATCTTACAATCCCTTCTGAATTTACTAAAAGAGAC

ACAGATAGTTGAGGTGGGAAATGTTGCCAAACCAGAAATGAATTATCACGCTCCAAATTAACTTTGGAAGCCAACC

TGCACATACGTGTCTTCATGAAGAGTATGCTGAAGCTGGATCCTCCAATCTTGCTCCAGCAGTGAGCTGATTAAGTT

GATGAGGGTAGCATACGTGAGGATGAAACTTGTTGGTTAATTACTTAATTTCTTCCTAGGACGAGTCTAAGAATCAG

ACTCAAACTAATAGAAGCCTAGATTCAAGGCATGACAGAGACCATAAAAGATGGCATGGAGTTCAGCCTTGAGATT

GGTAGACACTCCACACGATCTTGATTTCATATTTTTTTTCTTAAAATAACTACATACATATTAAGTAGCATGGTTTTA

AATTATGATTGTGATTACTTTAAGGTGAGTCATAAAAATCTTTTTATATATTGCAGCTAATCACTGGAAAGTATGGCTG

ATGTGGTTACAATTAGGAGTCTTCTTAAAGCATTAATATTTTTTAACTTAACAAATATAATTAAAGAGAAGTAACTAA

TAAGATAATGATCTAAAATTCTTGTATTGATTGGAAATAGCGTAAAAAGATGTTTCAAATATAATGATACAAACTCT

TTAAATGCAAATGGTTACATGCACAAAGCACGTGTATATATATGTATTCATACATACATACATATATATATATATATA

TATATATATATATATATATATATATATATATATATATATATATATATATATATATATATATATACGTGTGTGTGTGTGT

GTGTGTATATATAGGGAGAGAGAGTGTGTGTGTGTGTGTATTAGAGAGATTTTATGGTTGTAGTTTGTAGGGGGAGA

GAGGGGGAGATGGTTGGGGGGGGAGAGCGTATTTTTTTTTTTTTTTTAATGATAGGTTTGTGGGGAGAGAGAAGTGG

AGATAGGAAGAGAAAGAGAGAGAATTTATTTGGTATGGTTAGAGGTTTTATATTTTTTTCNTCA

BAC99.FASTA.SCREEN.CONTIG5 (SEQ ID NO:181)
CTAGGAGGATCTATTTCTTTGTTGTATAAAATCTTTGTATAACCTTAGAAATTATGAAATGTAAAGTCATAAAAAGGA

ATATTGATATACTCTATATTGTTTCTAAGTTTTTTACTATCCACTTTGTAGTAGTATTGAATAAGTAAAATTCTATCAA

AATCTTTCACACAAATAAAATCAGGTGAAATCTCAATATTATGATTGGGCAAGATTTCCCTCATGAATGATAGAATC

TGAATTTTATTTGATTCTTGCTTGCTGGTTGATTTTTTCTTAAGAATTTAACAAATATATCTTTTATATATATATATATA

TATATATATATATATATATATATATATATATATATATATATATATATATATATATATATATATATATATATATATATAT

ATATATATATATATATATATATATATATATATATATATATATATATATATATATATATATATATATATATATATATATA

TATATATATATATATATATATATATATATATATATATATATATATATATATATATATATATATATATATATATATATAT

ATATATATATATATATATATATATATATATATATATATATATATATATATATATATATATATATATATATATATATATA

TATATATATATATATATATATATATATATATATATATATATATATATATTTGAATATATCTACGTACATTCATATATGT

ATGTATATGCAAACATATATACATCTGGATAGAGAGAGGATCAGAATAGCAGGACAAAGACAAACTTGTATTTGTTG

CTTCCATACTAGAATTGCATTTTCTTATATCAACTGTGTGGAAGGGAAATTTATTAACAGCGCTAAGTATTCTCCTAA

CCTTAAGCAGGATCTCCTTCTGGTCTCTTGCCATCTGAGCTTGCATGTCAATGATGAAAAACCTGACAAGCGAGTCC

GCAAGTGCCTCAAGTTGTTCCTGGTAACCAAGCTTTGTCACATTGACCAAAAAAACCAAGGTGACATTGACCAAAA

-continued

AATAGTCCTGACAAGATGTTGGTAAAAAAATATAATCGGTTAATATCGATCACAAACATCATTGACTAAGGTTGACA

AAAAAAATTTTAACCGACATTGATAAAAAAATAACTTCGACCAATGTCGATCAAAAGAAACATAACCGATTTCGGC

CAACAGAAATATTTTATATGATAGCCTTTAGTTGCAAAAAGTGTGAACCAGGGGGTATTTTGACAGCCGTAAAACAT

ATCTCATGGCAGTGGTTGTTATATAAGGCAAAAAACCATGAACTTTCTTCTCTTGCTGGTGTTTGGAGCCACTTCAAA

TGTGATTGATGTTAGAGAAGTTAACAGTGGCATTTTTTAGGACTGAAAGTTAACTTAGGAGAAACCATTTTTTATGTA

TGTAATACGGTAACACATGTACCTCTTGCACAGATTGGGGAGAAATTGCAACTTTTTTTTTACATTTTGCCTTAAAAA

AAGTGTTCATATTTATAAAAATAATTTTCTATTTAACTTGGATATTTTTTCTTATACTACTACACTAAGGTATATACAA

CCTAATTAAGGCGTGTTTCTTAATTTGGAGACTGGTGCTTGATTGATTGACTACCAACGAAGGATAATCTAAAAAGG

AGAAACACCATTTATAATCCTCATGAGTGCTTATGTCCCTTTTGCCTTGAGGTAGATGAGTCGGCATCTCACTGTTTC

TTCTCATGTCATAAAATTCTTGGTACTAATTTGGAGGCAATGTTACTCTTGGCTGCTGGCTGCATGTAAATGTGGTGT

TGCCACAATGACCAGAATCACATTTTTGGCAAGATTCTGTATTCGTAAGTTCAAATTAAGAAGGAGGCAGATGTATG

GAGGGCGGTGTGGGCATCAGAAATTTTGGGGTGTATGGAATGCTAGGAATGAGTGTATGCTAAGGAATTAATGGCTC

TTTCAATGCTGAGAAAATTACGCAGAATATATTATTCTTTGCACGATCGTGGATTAATAAAAGCCAGAGTCCCTAAT

TTTAATTATTGTTTTACTTAATGATATATGGCACCTGGAGCTTGTTTCATGAAGAGACAATTTTGAATGAAATGTGAA

GTTAATTTGATTCGGTGGTAGCTGCTCTTCGAGTGGGATCATCCCAAATGCAACCGATGTTTATGTGCACGATGGTG

GGGGCTGGTTAGTGATGCGCATCAATGTTGCATGGCTTTAGACATGATTTTAAATTGCAATTATGATTGCGTTGCTTG

CAACGAACCTAAAAATCTTACATTGTGGATAATTATGGAAAAATACAAACTGATGTGATCATAATTATAATTGTGAT

GTGATTACAGAGTCAAAATACATTAGCGTTATGACTGCAATTATGGTTGCTGACTACAATTTAAAACCATGACTTTG

GGTGTAATGGTCCATGTTCGATGCTAGCTATCTTTGTCGAGATAGAAATATAATCTAACCATGGAATTTGCTTTCTTT

CTACTGTCACTGGTGTATATGTTTTTGGATCTTAGGTACTTTTGGTACCATTTAATACAAATCATTTTGTTGGAAAAAA

AACTACGGTAGCCTACATGCAATATACAAAATAAAATTGAATTACTATATATTATCATAAATAGTAGAGTATAAGAA

GTAAAGAAAATTCTAAAGATAAACATGAATTTAAAAACATATGAAACTAATATATATATATATATATATATATATAT

ATAATAATAATAATAATAAGAGATTGTTTTAACTATATATATAACATATTTAATTAGCTTAATAGAAATGCGAAAGTA

CAATAAAAAAGCAAAAACATAATAGGCGTGACAAATCGGTTGCTAATATACAATAAAGACAACAAAGTTTGAAACT

AAAACCTTATCCAGACTATCCAAATAACCCTAATTAATCATGCAAAAATTAGAACAGAAGAAATTTAATAACTATAG

CAACAGTAACAGCAGCAGCTATAGCTAATGCCGCGATCACCGAATCGGAAAACTTTTCATCATTGAAGTATTCTATT

TCACTAACCCTAAGCAAGATCTCAAGTTGATCGCGTGCAATAAGAGCTAGCATTTCAATATTGAAAAACCTCTCAAT

TGAGTCTGCAAGATCTTTAATTTTAGTTATCCACGGTAAGAATTATTAGCCACAAAATTGTATTTCCCTATTTTTGAA

CACTTGTAAACAACCTCTTTGCTCTTCCTCAATAGTTGTATCAGTGGCTCAAGTTCCTGCTGTGAACGGCCCAACATA

TTCCTGTACTTACCTATCTCCTGCCATGTTTACCGCTACATATTTTCTAGAATGTTATTTGAATTTCATTAAAAATCAT

AAGAAGCAAGTTTGAATTTTTCAGTGAAATTTTTACTTAGGTTTAGTTAGAAAACCCTATTTAAAAGCTATATTGTTT

TGCTTATCGAAACAAAACCAATTAGTTCGGTTTGAATTTCTTAGTTAATAAATCAATTTTATATGATTTTTTATACAA

AATATTAAACTCAATTTACTAAATAAGATTTATATCAAATTCATGAAGGTAAAAGTAATATTTTTATCTTTTAATGTA

AGGCTTGGTTTCACTTTTGTCCTTTAACTTTTTTTTATTTGATTTATTTCAGTTATCATTTAATATTTATGGGTTCTTCC

TTAAGGAATCTTGATTTTCCTATAGTTTTAATTGTTCTTCGGTTATTTATTCCGAAATTGAGAGGGGATCATCACCTCC

AAAGATTTCCTCGCTCCCATTAACAAAAATGTCTAAACAATTACCTTCCTTCTAAAAAAATTGTAAAGTACCTCCACT

AATTAAACTCAACATATTCTCCCATACTTCATTTTCTTTGAAAACAATGTTGTCTAATTCAAGACGCTTCGATATAAA

ATATTTAGTCGCTAGAACGAGAGAAAAAAAAATTCAATAAAAAGAAGGGATTTTTTTTTCTTCTTAACGTACTTCATG

CTACTTATTTGCTGGCAATCATTATTAATATATATTATCTTATATGAGACAATTTTGAACATTTAAATGTTAATTTTTGT

AAGTATCTTGGTAGTATCCTTTTCTGATAAGGAATAGATATTATTTTGAGATTATATTATGATGATGAATTGTCTCAT

-continued

AAAAACACGAGGCAAGCACTTGAAAGGAACAAATTCTCTAATTTCTTAGTGGGTAGTGGGAGAGAGGAAGTAAACT

TGCTTCAATAGGCAAATGACGCATGACGCACTCTTTATAGGAGAAGCAACACTTTCTAAGGTGCTTACCATAAAAAG

CATTTTGAGAGGCTTTGAACTTGTCTCGGGCCTCAAAATGAATTTCCATCAAAGCTTTTGTGGTGCCTTGGGAGTGGA

TATTGATACCTTGATGAATTATGCAAGCTTGCTTATTTACTTGAGACAGACTATATATGCACAACTGACAAAATAGA

CTTTAATTCTAAATAGCAATAAAAAGATATATAATAAACCTGTTTGAAAACGGAGGCTACTTCAATCTAGTACGGTA

GTTGACTTACTAAGTACGAAACAACAAATTAATGAGACTGCTGACTACTGATTTCATAGAAAGATTTAGGAAGATGA

GGAGTAAGAAATGTATGGTAAAGCTTCTAGGAGTAGAATATGTTACTATGTCTTAAAGTAAAAAAATATTTATGTTT

AAAAGATGAATTATGATTCATAATTATTTTAATTAAATATAAATAATAAAAGTTATATATAATATATTATTGGATCAT

AATTTATAATTTTATGTTTGTATTTCAGTCAATACATTTATAAAACAATTTAGCATAACATTTATGAACTAAATTTAA

AACCTTTATTTAATATTTTAAGATTCTTTCATTAGAAACAAGTTCCGGTATAGGAGTTGGTATCCTTTCAAATGATAT

AAAGCAATAGATTTAAATTTTATATTCTATTTTATTGTGTCAAAATAATGTATTAAATTCTTTGGTAAGAGACACTAT

AATTTTAAGTTATTAAGTTGATAATTAATTAAACATGATTTTAAATACTTACATATTTATTCACTTATAACTATAAAG

ATTTAGTAAGAGCATAAATAAAAAATGTTGTTATAATATATAATTTTAAATTTAATATAATAAAAATGTGTTAGCAAA

ATAGAAATATAAACATAAAGCGTGACAACACATGTTTTTAGTTAATAATAATAATAATATTAATTACAAATATTAAA

TAGGTTTTGACAAAATCATACCTGGCGCAAATATGCAGTTTAGTGACGGAATTAATTTGTGATTCATGCAATACAATT

TGTACCAATCATCATCATCATCATAATCTCTTTTTCGTTTTATTTATCAATGTTGCTACTTAGTACGAAAATTATTTGC

ACAAAATACAAACAGAATGATGCTATCTGTTATGAAAAGTAAATCCACACAGAATTACACGAAACATAGAATGGAC

GGTTATGATTTTATAAAATGAATATCGATTAAATTTAAATGTTATGGTAATTTTAAAATATGAATGATAAAATGATTC

AATTATTATACTTTAGTTTGTAAATAAAAATTGATTTTTATAATATTTAAAGTTTATAAATAATATTTTGAATAATTTT

AAAAATAAATTAATTAAATTAAATGCAAAAAACTGAAATTAAATATTGCTTAAAACTAATTAATTATTATTATATCAT

CTGCTCCATTATAATTGTTGTGTAAAAAATAATAATTCTAAAATAATTTTTATTTTTATTTTTTAATGTAAAATTAATT

ATGTTTTTTTACTTATATTTCTTATATATGAATGATGAACTACAAAATTTAAAAATAAATTATTGATGATATAAAGTTA

ATTTTATAAAATTATTTTTTATTTTTTTATTTATATAAAATAATGTATGATGATAATTATTTTCAGAAGAAAAGCAACA

CTTTTCTAAGATAAATTGTTATAGATGTTTAATATTATATTTTGCTTGTAAGACAAAAACATACTAACTACTAAATTA

TCTAATTTATGTATATTTTTAGTCCTTTGCATAATCGGGCGATAACTTATCATATGAAAGAATACTGATGATGATAAA

TACTTTTTGAAGAATAATAATTTTTATGAAATATTTGAATTAGTTTTACATTAAGAGTTTCTAATGATCTTAAAATGAT

TAAATGTATTATATTATATTTAGTAATATACTTAAAAATTTAAATATTGTTGTAATTTTAAAATATGAAAGGATAAAA

TAATTGAATTATTTTACAATGGTATTTCAAACAAAAATAAATAGTTATACTTTTTTTTTATAATACTAGTATATGTATA

AAATAGAAGAAGATAGATAAATAATACAAGTTATATCCAATTACTACAAGTACGCACCGATCAATTTCAATAAAAA

AAAAAAACAAGGTGTGAGTGAAGTCAACAATTAAGATAGAAATGAAGTTGGAAGAATCATCGATTTTAAGATTGCA

TTATATGCTAATAATTGGGCTGACTATATATACCCAACAATTAATGTTGTTATCGTTGTTGTGCTTGTCTAGTGAATG

ATGGCAGATGTTGTATTTCAAGGTATGGGAACTGCGTGGCAATTTCTGAACGTGATTATGGTCATAAAAGACAAAGT

TACGTTCAAAACAGCATTGGAAAACCTCCAATCCATTCTAATACGCAGCTTGTTTCTGATTGTTCCAAAGTCCACAG

CTTAAATTTTGTGGCCAGGCATCGTTACAATGTTAAACTAAAGGCATTTACAAAGTCATTTCGGAATATTTACTCCAC

GGTCATGTTAGCTCAGATTGCAAGAGATCAAAAAGAGAACCGTAGGAGTCAAATACTACTTGCCTACAATAATCCT

GCTCAGTCTCATAAGATTCTAAGTATTGTTGATATATATTAATATTAAGGGTCTATCTGGATAAATGTATTTAGAAGT

ACTACTAAAAAAATCCATCTCAAAGCAGAAAACGCCCTTATTAGCTTCACAGCAAAGACAGAAATCCACGTCAAAA

ACATTAACAACGTGTTTTCAATTGCCTCCCCAGGGTCGAAGCACGTTTTCTCAACAACCCTAAGCAATGTCTCCTCT

GATCTCTTGCCATCTGAGCTTGCATGTCGATGGCAAATAGTTTCCCGAGCTCGTCGAAAAACCGGTCCAGTTTGTCC

TTGTAACAAGCCCTAGTCACAAAGTGTAGCCACCGGATTTTTGAACACTCGAAAACAAGCTGTGTCCCCTCCTCCAT

-continued

CTTTCTGATAAACGATTGGAGTTCCTCCTTCGGAAGCTGCAACTCGTTGTTTTTCTGTTCTATCTCCTTGATCACCGG

AGATATAGCTACTAGAGTGGATATTGGAGGTGCACCAAAGATGATTTGAAGCAAACCGTTTTGTTTTTAAGTTCCAA

AACGGTTTCCCAGCAACTCGTTGAACACAGCTCCCACTGTTGCTTCTATTAGTAGTGCCATGATATTCACAACAGAAA

CACGCACCCACAAGGATGAAAACAAGATGAAGAAATAAACCTCTCTTTATAATATATAGAGTCAGGTTAAACGTAA

TGTTAAAAAGGAAGTTTCTTGGAACTCCATTTCTATCCTGTTGACTTTACGAACTTGTAGCTAGGTATACTTGTTTGT

ATTATTTACCGACTTGAACATATTTTTAATTATTTATTTAATTAACTGAATAGTTATAATTTCCTTAATAGATGCGAGAT

GCCAAATCTTGTTCCACCCTCCAACCCCAAGGATAATTAATAGTTAAGTGTGAAATAGTATGTGTGTGTCTATCTATA

TATATATTATAAAATTTTTTATACAATTATCTAATTATAACATATTATTTATGTGAGAAATTTATTAATTTTTTAAATA

ATTCAAATGATAATTTATAATCAGATGACCGTGTCAAATTATTTTATACCATCAATGAATAAACATTAATCTCTCTCT

CTCTCTCTCTCTCTCTATATATATATATAAATTCTAATCAAGGTTGGTTGAAATTATCTTACACTAAAACTACCATTAT

TCTTATTCAAGAGTATTTCATGATGAAGGTTGGATTTTAGGAGAAAAATTCCTAAAAATTCCTTTTTTTTTTTGTGCAA

GTAAAATCTAAGAATTCAAATTGAATTTTATCATTGGAGCAAAAAATGATAGAAGTTGTTGCATTCTATATAGCATC

ATATGACCCATAAAAAATAATCCAAGAATCCAAAAAGGATTCTTTAACCAAAGATGCTCTAAGAATCTCAATATTTT

CTCACTTAAGAAACATAACTATCAAATTAATATACTATGAAACGAGTTTAATCTTTAGTGATTTACTTGAGACAAACT

ATATGCACTACTGGCATAATAGACTTTAATTCTAAAGAACAATACAAAGACAACAAACATGTTCCGGAAAAAAGCT

TCCTCAAAATGGAGGCTACTTCAATTTAGAACACTCACGTGAAGTGTATTGTATAACATGTCTCCTTAGGTCAGAAT

GAGAGCTTTTTATTCGTGCTTGAAGCACGCCCCCTTCAATTTTTACAAGTCGAGGTCTTTATGTTGTATCAAAATGTT

CAATCATATCCAGCTAATGTTGTCGTGCAATTAACTTTATGATAGTTGTCCCTTCATGATGACTAACTGTCGTACCAT

AAACAATTCATTAATCCCTTACTTTTGCTAGCGAGAAAATTGTTGCTGCAGTCCACTGTAATATCATTTGTTGCAAAA

AATTTTGCAACGATATTTAATGTCACTACCACTCTTAACGCTTTCGCAACAAAAACTTCTACTATTTGATAACTACGA

AAATTAGGCTTAATTGATAGTCAAATTTAACTAAAAATGATTAGAATTTCTTTATTTTATTATTATTTTTAATAGAATA

ATGAGGATTTTAATATCATTTTAATTCTTCTTTCAAGTTTTTAATTTCTCCTCCTCAGTAATCTAGATTCCATAAGATA

CTTCTTGAAGTGCAGCTATGATTTTTTTTTTTTTGTATTTTACCATTCTTTTCTTAAAATTATCATACATAATTATATAT

GCTATATACTTGTTGTTAGGGAAGAAGATAAAAGTTGGTTTTCGAGGATCAGGGCCTCCACTGAGAAAAGGATAAGG

GAAGGAACAGTTGTATATTCCATTGATTGATGCTGTTATTACATAATATTATTTATACTGATTTCTCAATAATCAAAT

TTGTCTTTTTGTGCTACAGAATATCAGCAAATGGTTAAGTTTGTCTACCCCTACAGTACAGTGGCGGATTCAAGATCC

TAAGTCAGTTGGTACAAATTATAAAAAATAAAATCAGTGGGTTCAATTATATAAATATAGATGAAATAAAATATAAA

AATATAAGATTTTATTTACAAATTTGGTGAATTTTAAAAAATGAGGGGATGCAAGTGCACACCCTCAGATGGCTGTA

GGTCCGTCATTGCTTCCAGATATGGTGCACCTGCTTGCAATCCTTGAGCTAAGTGGGCCTTGTAATTGCTCTCTTGGT

CTTGTTTTCTAATTGCACCCTTTTCTGTTGCTTGCTTGCTGCATTCTCATCCTCTGTTTCTGCAACTGGTTCCTTTGCTA

CGCTATCACTTGTGGTGCCGTTTTTGGCTTTTCCAGTCTTCCCAAGTTCCCACTGATTCAAATTCCAAAAGTTCTGCA

AATAAAATTGAAGAAGAAGCTAGAGGTGGGAAATACTTAAGTCATTCTCTTGAAAAAGTTGCAGCAATGATATGCA

ACAAAATATCACTATACCGAGTCAAGGTAATTATTGTGTTCACATGAACATTTCTCCCATGAAAATATATATTTTCTG

ACTTTGTAATCTCTTTATAGTATGCATGGAAAAATAATTTTCTGATTTTTTTTTCTCTGTAGTGTTATATATTATTTTTAA

TCACATTTTCTTATTTATTTAGTTTGTTTCTGATTTGACATCATGTGAATTTGGAGATTTGGGTTAGAAATATTTTTGG

AATTTTCCTGGTTAGAACTTGATAGGTCCATAATGAAGGTATATAAAAGGATAGGGAAAAGAGGGAGAGCGGAATA

GAAAAAGAAAGGACAAATGGGCCTCAAAAACAAGACATGCTTGTGTATGACAGCAGAAAGAATCAGCAGTACAAG

TTGCACTAGCTGAAGTGGAAAAGGAACATAGGTTGACATAATGGAATGGATAGCTTGTAAGGAGAGTGTACGTAGA

GGCTGAGAATAAGTTCTTCCTTAAGAAAGGGAGTGGGTCTGGGTTTGTTTTTTCCTAATTACCATTCTCAACATCTGG

CTTGTATCCGCCACTCCCCTTCTCTCTGAGTTCTATTTTTCATACTTGGAAGCCTATTTTTTTTAATATAAATATAAAA

-continued

TTATGGGGATATCTACCTGTCAAAACTTAATATAATATATTAGTATCTATTATTTATTTATTTTATTGATTTTATTTAGT

AAAAATCACCCACTTTTCTTTCCGCATACATCTTGACATATATGTAAGGACATTGAAATCTTTAATTCATTAATATA

TGTTTTTAGGAATAAATTAACATGTGTTCTTTCTTTAATTCTATGCGTATGGGTTAACCAATATTCAAACTCTAGACC

ATTTAGTTAAAAAATACAAGTCATTACTATTTGTGTCAATCATTATTGGTACACTGCACAAGTTTAAAATCTAGTTAG

ATTTGTAAAGAAATGTTATGTTACATTTCAAATGACTTCTGACTTTCTTTAGTAGCTAAAAAACTTGTTTAACTATTTG

ATAAACAAGTTTTTTCAATAATTTTTAACATTTTTTAAAACGTTACTTAAATTAATATTTTTAAAAATACTAGTTTCTA

ACATTTTATATTTTTTCTTATTTTATCTTTAATATATAAACTTAAATCTTGAATTAGTTAGATACAAGACTATATCCA

ATCCCACTTAACTAACCTCAAGAAATTAGATGTCTTATATAATTATTAAATTTATTTAATACACGTCTTTCATTTTGTA

ATGATAAAAGATTTACTGATAATAATGCATTCCTTTTATAGTATTAATTATTTTATTTCTATTATGACATTATTTTCTT

ACTCTAATTTTTAAATATTTTTACTTCATAATAAATATAAGAAATGTAATATCAAATATTATATTAAAATTAAAATAA

TTTTAATACGAATAAAACAATTAATCATATTTCTAATTTATGCGTTATGTTTTTAAGCTGAAAAATAAAATTAACTGT

AAAGATTTGGGTTTAGTTAAATTTATTCGTAATTGACTTTAGAAGGAGTAAATTGAAATACACTTTTAAATTAATATT

TGAGTTTCTCTATCAAAAAAGGCTATTTGAGTTTTATATTTTTATTCCGACGTCAAATTCTTTGATATGTATAGACTAT

ATTTGAGATACTTTTCGCTTTGAATTTCTATCACGCTCTGAGAAATCAAATATATATATATTTCTCTTGATCTTAACTT

TAAAGTTTAAAGTGATATGAGATTTTTACACATACTAAAACAATTTTTTCTCAAATAATGCATCCATTGATATCCTTG

TCTTTGGGTTTGGATCCAAGAGTTTCGACAGCAATCTGCGTACATCTGGTGCAATCCAGTTAGGAAATTTGAACTCTC

CCCTGCCAATAGAACATACAAGATCATAACTCCTTCTGTTTATCACTTTCCGGAGCAGCATAGGCAGGGGCACCACAT

GTAGTGTGGAGTAATCCATTTATATTCCCATTTTCATCCAGTAGAAGATTTTCTGGTTTCAGATCACGATGGCACACA

CCTCGGCTATGGCAGTAGTCAACAGCGCTGATCAATTGCTGAAATTATCTCCTAGCATCATCCTGCTTGAGCTTTCCT

TTGGATACCTTATTGAAGAGCTCACCACCTTTTACATACTCCATAACAAAGTAAATTTTGGTTTTGCTGGCCATTACC

TCGTAAAGCTCAACCACATGTGGATGCCTGGTTAGCCTCATCGCTGAAATTTCGCGCTTAATCTGATCAATCATCCC

AACTTTCAGAATCTTCTCCTTGTCAGTAATCTTAATGGCCACACTCATGCCAGTTATGATGTTCCTAGCATGGTAGAC

TTTTGCAAAGGTTGAACAAGGATAGCTCAGATGGAGGCACGGACTCATCAACCTCGGTGAAGGAATTCTTAACTGTC

AAGCACATCTTTCACCATTCCCTGATTTTGGTGATGACACTAGAGAACAATGAAGAATATGGACTTCTTGGAAAGTT

TGAAGAATAATTAAGGAATGATGCAGCACCTGGTTAGCCTTCCAATTACCCAGCAGCAGAATATACAATGAAAGAC

ACACCTGAAAGAAAGATGAACAAATTTAATAAGTTGGGATCATTGTCAGAGAATATAATCTCCTGAATAAAATTCTT

GAAACTTCTACAAACATAACCAGCATAACAATTTTTATAACTTGTTTCTGATGTCATTTTTGAACAATCCCAAAACCA

TAAGGCATTAGGTGAGTTTTGATCATATTTAAACAGGACTGGATTAAAAAACAAGTATTTAGCACATCAATTACAT

TTCTCTCAGGTAGTCTAGTCGTTTTTAGAGTTCTTATAAATAAACGATTCATGACCAAGAAGAACAACACAAGACTA

AACAAGTATGACAGAAATGTAAGATTGTCAAAAATCAAGAATAAATCGAAACCAGAGATGGCCACACATTATGCAG

AAGAAATAAAATTTAATCAAACAATCAATCAGCAGATGGCAGAAAGCACACTAATACAACAAAATACATCAATAAT

GAACTTGAGATTCATAAAAAAGGAGCATGCAAACAAGTGAGACCTGCATTCTGTTTTGAATTACATAGACAAATCAA

GTCATCACACTCATCTGCCCAAATTAATCGTCTAAAGTTGGGAGAGTTTAATGACACTCGAGAAGAAAATGAAAAT

TCAGTAAGGTTTCAAATAAGCAAGTATAAATATAACTGAGTTGCCACCGTTTTCAGATGAATGTGGTTCCACTTTCC

ATTACAATCGTTACCGTTTGGCAGTCTATCTACCAATTTTCATGCTTGGGTCACATGCACTAAGTTATTGTCAATACA

TATTGGCAACAAATTAAAATTTTCCAGATGAAAAAAAAAGGAAAAAATTTACAAATTTGCCGATAAGAGAAAAAGG

CAAATAAACACAAACACCCCTCTCACCAAGAGAGAGCTTAACTCATGAAAATAACAACCATCCACCTATACCAGAA

TTTGGTTTTAAAATATCATAATTTTGTACTGTTTATTTTTAAACATGTTATTATTTGTAAAAATTGACCAAAGGTGCAC

TTAGATCTTCTCATGCTACACAAAAATCAAGTAATAAACATTAAGAAATATTTGTTACATTTAATAAGGGAGATTT

TCATAATAAAAAAAATTCTGAATTTCAATAAAAAATACATTTGATGATCTATTTTTTGTAGTATAAAATCTTTGTATAA

-continued

CATTAGAAATTATGAAATGTAAAGTCATAAAAAGGAATATTGATATACTCTATATTGTTTCTAAGTTTTTTACTATCC

ACTTTGTAGTAGTATTGAATAAGTAAAATTCTATCAAAATCTTTCACACAAATAAAATCAGGTGAAATCTCAATATT

ATGATTGGGCAAGATTTCCCTCATGAATGATAGAATCTGAATTTATTTGATTCTTGCTTGCTGGTTGATTTTTTCTTA

AGAATTTAACAAATATATCTTTTATATATATATATATATATATATATATATATATATATATATATATATATATATAG

ATTTTAATGCATTAATATACTTAGATTAGATACATTAAATTTCAAATTTCTGTAACAACCTTTGTGAATTATAAGGAA

AGTCTGGTCAACTAAATAAGCTAATTTACACTCATGCATACAATCGCTTCACTTGAACTTAACTCAATCGTCATCATC

ATTATTATAGTGAGTTAATAGAAATGCAAGATTCTCATTACTAAAAAAAAATAGTCATTACTAAAAAAAATAGTCAT

TCCATAAAAAAATAGCTATAAGAGGTCTTGTTAATAAATATTCTTAAATACTAAGAAAACTTAAAAATATTAAATAA

AAATATAATATTAGTATATTAAAATTGTTTGAAATTTAATTTATTATTCAAACAATTTGCTTTTTTAAAAATCTTAACA

ATTTCACTTGTTACAATGTGACAAAACATTCAAGGAAGAAAAAACAAAGTTAACTTATATGTGGGAGTGAGAAATA

GGACAACAAATGAGGCTATAAAAGTAATATATTGTTGATAAATAGAAAAAATAAGTTATATAATAAAATTGTAAAA

CAAATTAAAACTTCATTCAATAATATTTTATCATCTATAATAATTATGATAATTATCTTAAAAATCATATTAATGAT

GATATATGAGTGAATGATAATATAAAATTAATTTATACTTAATGCATGAGTTTAAATTATAGAAATATTCTTAAATAT

TAAATAAAAATATAATAATAGTATATTAAAATTGTTAAAAATACTGTATAGTATCGTTCAAACTTTTGGTCCTTTA

TTAAATCTTAGTAACAGCTCCCTTGTTACAAAGTGACAAAATCTTTTGGGTATGAGATTGGTGAGAATTAGGGACAA

TGAAAATGATGGCATGCCAAACATCGCTAAATTGACCTAATGGGGTTAGTTTTACAAACTAATTCCCAGAATAGGTC

TGTTTTAAAACTATTTTCAAGGGGGTTTCTTTTTTACGTAGATTCAGCCATGCATGCATGTATATCGCCAGCATGCAT

GTATATCGTCAGCATGCATGGCGAAATACGCCTGCACTGGACATGTGGCTATTCCGCCAGTGTCACTGGCGAGATAG

CTGGCACAGTTTTTGCCACTTTGACTGGAGATTTCGGTGCAGAGGGCGCAGGCAAGGTGCAAAGGGCACAGGATAA

CAGTAGGGCAGTAGGGTTCAGGCTAAGTTGGTTTTGCAATCAGTGTTGGCGAAACAAGGAGCATATATCGCCAATGG

TATTGACAAAATAGGTGTGTTGTGCCCTTTAAGTAGCAACTTCATGTTGATGCTTTCGTGCTGATGCTTTGTGCCTTT

AAAAATTTCTGAGTGTTCTAAGTGTTTTTAAAGTTTCTCTCAATCAGTAATTTCTCTTCTCTGGCATCGTTTTTATTTA

TTTGAAGTAATTATTTTGAGTCTGGAATAAAATTTGAGTTTCGACTGGCATCATTTTTATTTATTAATTTCTTTGGCAT

TTTTTTATTTATTTAAAGTAATTATTTTGAGTTTGGAATAAAATTTGAGTTTCGAGTATTTTTTGTAATTAGATTTGTTT

ATTTTGAAGTTATTAATGTTAAGATTAATTATTTATAATAACAACTTCTTTAATGATTTGTTCTGCCTTTAAAATGTCT

ACTTTCAAAGGTTTCCGTTCTGCCTTTAAAATTTTTACTTTCAAAGCGTTCAAGTTTTTTAAGTTTCTGCATCATATAA

TTAATTTTTTGTTAGAATAAATTTTTAATCTAAAGTTTGAGTGTAGTATTTTTTTAATTATATTTACTTATTTTGAAGTT

ATTAGTTTTAAGATTAATTATTTATAATAGCAACTTAGTTGATGGTTTGATGTGCCTTTAAAATTTCTACTTTGAAAGC

GTACAAGTTTTTTAAGTTTTTGGCATGATATTTATTTGAAGTAATTAATTTTTTATTAGAATAAAGTTTTAATTTGAAG

TTTTAGTAACAAGGTTTTTTGTTATTAGAATACCCAAAATAATTTAAAATAACAAAACAAAAATTTAAACAATATAT

ATTCCAAATTCATACAAACTAACATACCATATATTTGAATAATAACTTAAAATACCTAAAATAAATATAACATCCAA

ACTTTATAATACCTAAAACTAAAACAAATAATTTAATTATGACCAACAGAAAAAATAAAACACAAAATTTTTTAACT

ACATTCCAAGTTTGAAAAAACCAAATATGGGCGGGAGAACATGCAGCTCACAAGCTTTTTGTCACCACCAAAGCGT

AACGTAACAACACCAAACCACTACTAAAAATAAAGGCCTTGTACATCGGTTATAACGACCTTTCTACATCGGTTATG

ACGCGTGGTGGTAACCCGGGGTCGTTGAATCACAACATCGGTTTTATGACCGTCTTTGAAGGCCGGCTTTTCTACAT

CGGTTGTCTAGCTACAACCGATGTAGAATGGGTAACTTTCTGCAGCGGTTCTCAGGCTGAAACGATGTTGAAAGGGT

AGATTTCTACATCGGTTATCAGTCAACCGATGTAGAAAATGAAAGGTTTCTACATCAGTTATAGTTCAACCGATGTA

GAATGACTAGATATGGTAACGTTGCTACATCGGTTATCAATCAATCGATGTAGAAAATGAAAGCTTTTTACATCGTTT

ATCGTAAAACCGATGTAGTATGGGGAGATTTTCAACATTACCTTGTATTGGAGGTATATTGATCCTTTCCTTTAGCAA

TAAAAAATCGAACACGATGTCCCAACTATACTTAATTATTCAATTCAAGAACCTGTGATTACAACAAAAAATTGATT

-continued

```
TTCAGGTTCAAGTCATAACAACTGAGTATAACTAAGAGTTTTCTAGAACTTATTAGTATGGTACTGTATGACATGGAT

GACAGGATGCGATTTCTCATCACAGTATAAACTAAAAATTCTTATGCATGTGTAGAGGCTACCACTTAATGTTTTCTC

ATATGGCTACTACAAGTCACAATTTTCTTGTGCAATGACTAAAATTTAAAATAGGAACTATAAGGCACAAAGAAATA

GTTTAACCAACGAATTTCTTGTAAACATAGACAAAAGTCAGAATGGAAGGACCTCAAAATGACCTGGCAATAGCAA

TTACTAATTTGATAACTTATAATATCATACATTGGGTACAAAATGAAAAAATAAAATGTTATAAACATATAATATAA

AGAAAATGATAACTTAATCATGTAATCATTTTGTTTTCTTCTAAATTTCAAGAAAAATATTGTAAGTAGTATTCCAAG

TGGAAGCAATACCAATCAAGCACTGGACAATTTGAATCTCTGTCAAGAAAAAATGCTACTGTCTTATGGTATTTCAA

GTAGAGATGACTTCTAGCGTGTCACAGGAAATAAAAACCATCTATTACGAAAGATAGATGTAGAAAATTAAAATGA

AAATAGTACTGTATGCATCAATCACAGGAAATAAAAAACAGGCAAGACCCTCGATATTGTTCATCTAACACGTGCA

AAATATATTATTATACTGTATGAAGTATTTTGATCTGGTAGTATAATTAGGGTCAGTGCTTGAGCAGTTCAGAACAGA

GCGCTGCAGTGCAATAACCAAGACAACAAGGACTGACTTTTTTTGGTTGCACAATAAGTACTGTCTGACACTATGAT

TGCCACAATAAATAGTTTAAGAGCAAATTAGTAATAAATGTCAGTTTGATTTAAACAATAGTATTACACTCCTGGGC

TCAGTGGGCTTCATGCATCGAGCCAAGTCCAGCGAACGTGTAACACGCTCCAAATTTTATTTAATAAATTTGTTACT

ATTTAATTTTTAAGTATTATTTTGTGCAAGTTGAAGCTTCCTCAGTTCCATAGCACTACTATAGCAGCAATGCTTAAC

TAGACACTCAGAAGTTAAAATAGAAACCTGAACTATTAAGTAATAAAAACCAGTTAACTGTTATAAACACCTTCAGA

GTATATCAGTATATTCCATATACCTAGGCTTATTTTTTGGAGGCAAGAAGTTTCTGGTACTCTGCTGCCTCTGATTTT

GCTTTGGCAATTCTCTTCTTATCTGCAATCCTTGCCCTCTTTCTTTGGAGGGTCAGGGGAGTGACCAGCCGTTGTATC

TTAGGACCTTTGCTCACCTTTTTCCCTACAACCAAACATATGCAACTCAGACTAGAAATCATCACAATCATGTCCAA

AAATAATCTCCTTCAATGGGTCCTACCCATCAAACAACAGCATAAATATGCAAAACAAAGTTTTCAAATTTGAACGA

GAAGTGATAGATCATAGGAGATAACCTCTTACGATACATGTACTAATTTTTTAAGATTATCAAAAAGAATGACCTGA

AGAAAACACATTTTTATCAGAAGTCCTATTTTTGCTACACACACAACTCTGAATGGATAATTTAGATAAATTCTTACT

GCAAACAAAATATATATACAGGACCACAGATAAATTTCAAAAGAAATTTTCAAAAACCAGATAAGCTCTGTTAATGT

GGTCACCTTAAAAAAAACAATCCATTATTAAAAAAAAAAAACTTACATAACATCACGTAAATTTATATATTTCATAG

AATGATATAATTTTTTTTGTCTCTATCAATTATATGAAGCTCTATAAGCTTGTTCAATGGTAATAGAGGCAATTAGAA

GGTAAGACATGCATGTGTACTTTGTGAGAAGTTAACCAACTAATTCATTTGTTGTGACTTTGTTAAAAAAAATAAAA

ATTGTGAAGAACGGCTTCTCTGCCAACACAACCAACTTTAGTCAATTAGGGTGTGTTGTTTGGAGAAAAAGAGGATA

AAAGAAAGTAGAAATCAACAAAGTGAGATTCACATTTCTACACTTTAGTTTTAAATTTTTATCTCACTTTAATTTTTTT

TTTCATTTCTTTCCACTAACAGACCCTTAAAAAATTGAAAAAATAATGTGGACAATTTAGTCAACTCACTAACACTAT

TATAAGCAAGTGGGTTTTAAATTTTGAAAAGCATTACGCAATAAAAAAAATTAAATGTTAAACTACAAATCATGAAC

AAAATCATATATGGGATTTACTAGATGAGAAAATCCATTGTTTAATTTCCTTGAAAAGGAATTATTACTCGGGTTTTT

TTTTCTAAGCAATTAAGCAAAGAGATATCATTAATAAAAAAGCTAGAAGACTGTACAAGATTTACCTAGGCCAAGTC

ATAAGACAACATACAAAGTTTAGAAGCAAATACATCAGAACATAAAAAATGCAGTAAAAACCAGGATCATCCTTTA

CCAGTAAAAACCAGGTTCTCATCCAAACTTGGCCTTGTTCCTCTCTTTCTCTTTTCGTGTACCCGTTGCTAACCACGA

AGCTTGATGACCATGACATGACCAAAAATAAAATATATCAGAAAATGATAAGGTCGAATAATACGTTAAAGGGCAA

GGTAGATCAGCAGTCGTAAAAAGTACTTTTTTTAGTAGTGGAAGTCTATAGTTGTATACCTCTCAGAGCAAAACTAC

TTTCTATTACCATCAAGCGCTTGTTTCTTTACAAATTACATAACTAAACTTGCCCCTCTTTATATTCATTAGTATTTTC

AAATTTCATCCTTTCATCTTTTGACTTTTAATGCTTCTTTTTCCTGTTATAACATTGCTTGTTACATGTTTTTTTAGTT

AAGGGTAGTGGATTGATTAATAAGTTAAATAGTTGAATAGTTACTAAAAAGTTGTATAGATACTAAACTTGTATAGA

TAGAACATGTATCTTTGGGCTTATTTTAACTAATTACATTTAGTTGATTTTTTTTCTTCTCATTTATTATTGTCTTTTTT

GGCTTAATCGTGTTTGTTAACAGTTGTGGTGTGAAGTATTAATGAGGATGGGATTTGAAGCTTCTTTACACGGTTTGG
```

-continued

TTTTGTATTTTGCAGACAAATTCATTACCAAGGCAAGGACCAAACACAGGTCTTGCACTCCAGCTACCAAACAATGC

ACCTGCCTGGCAAGGTCCTAACACAGGACTTGCAATTCAGCCCTCAATCTGGTGTACAAAAACTTGTAATACATTTT

TGTTTCCAGGGCGTATTTCAATCTGTTTGTAAGATTTTTAAGATACTCATATCTGTCATACACAAATTCTCGTGTAGTT

GTTTGAGTATATAATGAAAGTGTTAAAAAGTTTCATCTATTACATATTTGTATTAATGGAGGGAAGAAGAGAATTAG

GTTTTATGTATAGGATAGGATAGGATAGAAGTATATGTAGAAGTTCTTTTTGGTTTTACTATATCAAATTAGATGTTTT

TTGTGAATTGTGATGAATGTTGTCATGACTTAAGGCTTAAGCACAGCAGGATTGGTCAATAACAGTAGTTCATTATGT

GGAAAAACCCCGAGGCTTAATTACCACATTAACATCTTATTTGCTCAATGTAAGATTCACAACATTGCTACTCCCTT

TAAGAAACATGTTCATGGTGGCTTCGCTCTATTTCCCCTTACATTGGCAGACTCTCAAATAATAATTCAGTACATTGC

ATCTTACTCTAGCCTATAATTAGGTATTTCAGCAGCTAAACTCTGAATTACCACCCATGGTGCCTTCACTTGGTTCCC

CTTACATTGGTGGGTTGACACACCAATGTATGCAGTAGATTGCATATCATAACAGCAGACCAATAAGTTGATTCTCA

TTCATTCTCTATTGTCATCATACTGTCAATTTGGGTCTGCAAAAATGTCTACCCAAATACACAAAATCTTACACAATT

ACAAGCTTGAGGAATTGACTTCACTAAATTAAGGCACCCAGCAAAAGACAATTGGTGAGCCTTCCAATTAGAGAGG

TGTTGATTCACTTTATTTAAAATAAATTGAAAGGAATTCCTCTACACTTTTTTTATGAAAATTGGGATTCCCAAATAC

TCTACCAGGTCATCAGTATGTTGATACCTCATTCTCTGCCAAATAGCCTGCTTTCACTGCCATCCCACATTATTAGAA

AAATAAATACGGGTATTATCATTACTAACCTTTTGGCTTGAGCTCTTAGAAAATAGGTCAATAATATGAACCATCAT

CTTCACTTGTTCCTCACTAGCTTCCGCATAAAGGAGAAGGTTATCAACTAACGCCAGATGAGACAATTTACGTGTTC

TTTTAACTATCTGAATAGGCTTCCACTGTTTTGCATCAATAGCAATTTGAATTAAGTGAATGATGAGGACATGACCAA

GAGCAAGGGCAAGGATCCACTTGAAGGACTTGGAGGACATATGACAAGGGCTAGAGCAAGGAAAGCCAAGGAAGC

TCTTCAACAAGTACTATCCATACTATTTGAATACAAGCCCAAGTTTCAAGGAGAAAAGTCCAAGGTTGTGAGTTGTA

TCATGGCCCAAATGGAGGAGGACTAAATGGCACCACTTTGTCTCAATTTTAGAGTGTTTAGTTTGTCTAAATAATGG

CTCAATCCTTGTAAAGTTGGTTGACCATAAATATGTTTTGGGTTAATCAACTAAAAGAGCTTTAGTTTGGTTTAGTTC

AAGTTGTAATAAGGGCCCAATTGGCAACCTAGGCATCAGCCTTTTGGGAGACCAAATGGTGGCTAGCTTGATGGCTG

TTGGGGGTGACTTTTGGTTGCCACAATTTTAGTTACACTTAGCCATTAAGTTCTTTTAATTCCCTAGGTTAGTGGCATT

AAGTTCTTTAATTCTAGGTTAGTGGATCATTACTAAAATCTGATGTAAAGCTTTTATATAAGCTGAACCATTTTATCA

ATAAACACAAGTTGAGTTTTATTCAGAAAAATAGAGTTTATCTCTTTTATCTTAGTGAGAGTGATTCTCCTAAGTTCT

TGAGTGATTCAAGAACACCCTGGCTATATCAAAGGACTTTCACAATCTTTGTGTGTTTCCCTCGCCGGAAAGAGTGA

TTCTTTCCTTCCTTTCATCTTCAACCTTGTTCTTTCAAACCACAATTCCAAAAAATCCACTTCTGCCCATAATTATCTC

GTGGCCATAACTCCTGTTTTACGCGCTCAAATTAAGTGATTCTTGAGCCTAAATTGAATTTCAAAACGAGATCTTTCA

CCTCGTTTTGGAATCACCTCATTTGGAGCCCTGTATCTTGAGTTATTGCCATTTCTATATTTCTGTCCAACCACCACTT

AACCTACGTTTTATCATCTCATTCTTCCATTTTATGCCAAGAACCACCTTATTAAGGCCCACGAAATTAGCCACCGCT

CAACCCTTAAATCTTGCAAATTTTCCATCCTTTCCTTAATCAATTTCCGCATTTTCCATCAAGGTTTAATCCTAGACA

ATCCTTAGTCAGCCTTTGTGCAATGAAGGTTCATATCATTTGGTATCAGAGCCAAGTTCTAGGATCAACACTTCCTTT

GCTGGAAATATTGGGTAACATCCTTCTTTATTCTCTTTGCCATTTATATTACCTTCTTATTCATATTTTTTTAGGCTGA

ACCATTGCAAAAGTTAAGCCTTTTGATCTCTTTGTTATATATATATTAAAAAAGCAGAAATTCGTATAAGCAAAATTA

AAAACAAAAATGGGCTGAATGGTTCATGCCTGAAGAACTTAAAAAATATATATATTTAAGGTAATATATTGGTAGC

ATGAAGGATTGTTACTTGAATTCCTAAATTCTGAATTTTATTTCCTTCATTTGTGCCTAAAAACATTGTTAGCCTTTTT

CTTGGTTAACCTTTTCCTTGTCTCTCTAGCCTTACCTTACACATATTGGTGAATTGTTCTTTGTTGTGGCCATAATCTC

TTGAATTGCCTAATAACTCAAGGGGAATTAGAGTGGTAAAAGGCAAGAGTGTTTCATTAGAGAAAAGCCATAATTGT

GTGATACACTTGAGTGGGTGAGGTATTCAAACAACAACTATAATTGTATTGTTATGTTTGATTTGTTTGTTTGAGATG

ACAGGAACAAATCCTAATGATGAAGTGGGGCTTTCGCAATTCCAAATGCAAGCTTTGATGCAACATTTGGAGAGGTT

-continued

AATGAAACAACGAGATGATGCACTCCATGAGAGGTTGGATCAAATGGAGAATAGAGATCATAATGAAGAAGAAAG

GAGGAGAAGAGGGAATGATGGTGTTCCTAGACAAAACCGAATTGATGGTATTAAACTCAACATTCCTCCCATTAAA

GGAAAGAATGATCTGGAGGCTTACTTGGAGTGGGAGATAAAAATAGAGCATGTTTTCTCATGCAACAACTATGAGG

AGGACCAAAAGGTGAAGCTTGCCGCCACGGAGTTTTCCGACTATGCTCTTGTGTGGTGGAACAAGCAATGGTTGATA

CATGGGTGGAGATGAAAATGATCATGACGAAGCGGTATGTGCCGGCTAGTTACTCAAGGGATTTGAAATTCAAGCTC

CAAAAACTAACCCAAGGCAACAAGGGGGTTGGGGAGTATTTCAAGTGTCATACCCTAATTTCGTCCGGGAACCTTTG

CTCGATGACATGCGACCATTCTTTGGTCCTTGTGAGGTGCTTGGCACCCATCATTAGGCAATTTATGAAATTCCAGGA

CATGCCGAAAAACCAAAAAAAATATTGATGCACAATCCGTAAGTTTCCGTGACACACCGGAAATCAAAAGGAAGCA

TCGTTGCATAATTAAGTGAGGTTCCGTAACATTCCGTAAGTCAAAAGGGGATGATTATGTAATCCGCAAGGTTCCG

TAACATTACGGAAAGAAAACAAGTATCGTTACGAAATTCGTAAGTTTCCGTAACTTTACGAAAAAAGAATCACCAA

AAAAACAGCAGAGGGGGTGTATTTAGTAAAAATGGGGGTGCAAATAGCACCCAGACCCACTTGGGCCCTCCAGAAG

ATTCCTCCAGAAGGCGGTTGCTTCTGGAGGAAGCAACCCTGCTCGCCTGGGCGAGCTGGGCGGCAAGCATCTCCCC

TATTTTGCTATAAATAGGGGAGAAAATGAAGAAGAAAAGGATCCCAGCCCTTTAGGCACTTCTCTCTCTTTGGAATT

TGCTTGGAAAAATTGTTTCCGTGAAGAAAATCTAAGCCGAGGCGCTTCCGAAACGTTTCCGTAACGTTTTCCGTGAG

GAATCTCGCAAAGGTTTGAACCGTTCTTCGACGTTCTTTCATTTCGTTCTTTCATCGTTCTTCGATCTTCAACGGGTAAGT

ACCTCGAACCAAGCTTTTCGATTCATTCTATGCACCCGTAGTGGTCCACATTGTGTTTCGTGCATTTTGATTCTCATTT

TGTTTACTCTTTATACCCCCTGTTGACGTGCTTAAGCCATTTTACTTAAGTCGTTTCTCGCTTAACTTAAAAATAAAAT

AAATTTCCACCGAACGTTTGAATTGTATTATCCATTAGCTTCGGTTAAAATAAATTCCGACCGTTCGGTCATGCCGTA

ACCACGTTGGAAATCAAAAAGAGGTAAAAAATAATATAATAATCAAAAAGACATCTTTTAGTAAAATAAAGCGGAA

AATCAATCGGACGTTTTCTCTTTGGGATTTCTCATTCTTAACCGAATTGATTAATAACTAAAGTGAAACTAAGGCTAA

CATCAACTCGCCTAGTCAAGCTCGTCCACAAAAAATAAGCTTTTGAAGTTTTGTCATTTCAATTTCTCACTAAGTAAAAT

GGATCATTTTTAAGGTCCAACGCCTTAAAATGATCACCACTTAAGTAAAAAAGAATCACTTGATAAGAAAGAACTAC

GTAGGTCTGATTTTCTCATCCCAAATTGAGGAATACGTAGGAGCAAAGGGAAACACCCTTGTCGACCACAAAAAAG

GAAAAAATATAAAAAGGGTATAAAGGATATAAGAACATAAAAGGGAATAAAAAAATCAAAGTCATGTTTGCACATT

CGATTAAAGGCTGCCGTCCCTTGGGACGGGCGTGTGGGGTGCTAATACCTTCCCCGTGCGTAAATACAACTCCCGAA

CCTTTCAAACTTAAAAATTCGTAGATCGCGTCTTTTCCGGTTTTTCCGACGTTTTCCTCAAATAAACGTTGGTGGCGA

CTCCGCACGTATTCCTTTCGTGGAACACGCATCCCGCGAGTCACGCGTCGCCCTCCCGCCGAAGGGTAGGTTGCGAC

ATCAAGGAAATGGATGTGCTTATGATTCAAGCAAAGATTGAAGAAGATGAGGAGGTAACTATGGCTCGATTTCTTAA

TGGTTTGACTAATGATATTCGTGATATTGTTAAGCTGTAGGAGTTTGTTGAAATGGATGATTTGCTTCACAAAGCAAT

CCAAGTAGAGCAACAATTAAAAAGGAAAGGAGTGGCTAAGAGGAGTTTTACCAACTTTGGTTCTTCTAGTTGGAAA

GACAAAGGTAAGAAAGATGGGGCTGCTACTTCTAGTAGTTCCACACCTACCCCATCAAAAACTCGCTCAAAGTCCC

AAGAGGAACCCTCTAAAAGAAGTAGAGATGTGAAGTGTTTCAAGTGCCAAGGCCTAGGACACTATGCTTATGAGTG

CCCTAGCAAAAGGTCCATGGTTCTTAGAGATGGAGAATATATAAGTGAATCCGATGTTGAAGAGGAAGAAGAGAGT

GAGTACGTAGAGGAAGAGGAGACTCCGGAGGGAGATTTGTTGATGATTAGACGGTTACTTGGTGGTCAATTGAAGC

ATAAGGAGGAGAGCCAAAGAGAAAACATATTTTCAAACTAGATGTTTAATCAATGGCAAGGTGTGCATGGTGATCAT

TGATGGAGGTAGTTGCACCAATGTGGCTAGTACTAGATTAGTGTCAAAGCTAAATTTAGCTACTAAACCACATCCTA

GGCCATACAAACTTCAATGGCTTAGTAAGGATGGGGAGGTACAAGTAAGGCAGCAAGTTGAAGTGGATGTTTCCAT

TGAGAAATACAATGATAAGGTACTTTATGATGTTGTTCCTATGGAGGCCAGTCACTTACTTTTGGGGAGACCATGAC

AATTTGATAAAAGAGCCAATCATGACGGTTACATCAAAAAGATCTCTTTCATGCACCAAGACAAAAATATTGTGCTC

AAACCATTGAGTCCACAAGAAGTGTGTGAGGATCAAAAGAAAATGAGAGAAAAACTTCTTCAAGAGAAAAGAGAA

-continued

AAAGAAAAAGTGAGCAAAACACTTGAGAGTGAGAAAAAGAGGGAAACACTTGAGAGGAAAAAGAGTGAACAAAA

GAAGAGTGAAACACTTGAAGTGAGGGAGAGCTATTTAGCCACAAAAAGTGAGGTCAAGAGGTTGTTTCGTGCTAAA

TAGTCACTATACATCTTGTTTTGCAAAAATCAGATTTTAACCAATAACACTTTTGATGATTTTGAAGTGCCTTCTAGT

GTTAAAACTCTTTTGCAGGATTTTCAAGACATGTTTCCATCAAATGTGACAAGTGGACTACCACCTTTGAGGGGAAT

TGAGCATCAAATTGATCTCATTCCAGGAGCTTCTTTGTCCAATAGGCCAGCCTATAGAAGTAATCCACAAGAAACCA

AAGAGATTCAAAGACAAGTGGATGAACTCATTAGCAAAGGTAGGGTAAGAGATAGTATGAGTCTTTGTGTTGTCCCG

GTGATTTTGGTCCCTAAAAAGGATGAGACATGGCGCATGTGTTTCGATTGTAGAGCCCTTAATAACATCACCATTAA

ATATAGGCATCCTATACCTAGGCTTGATGATTTGCTTGATGAATTGCATGGTGCATGTTACTTTTCTAAAATCGATTT

AAAAAGTGGATACAATCAAATTAGGATTAAAGAAGGGGATGAATGGAAAACTGCTTTTAAAACAAAATATGGTTTG

TATGAATGGTTGGTTATGCCTTTAGGCCTAACTAACGCTCCTAGCACTTTTATGAGATTAATGAACCATATCTTGAGA

GAGTTCATAGGAAAGTTCGTTGTGGTGTACTGATGATATCTTATCTATAGCACTTCACTTGATTTGCATATTATTC

ATTTAAAATTTGTCTTGTGTGTGCTTAGAGAAGAACAATTGTATGCCAATCTTGAAAAATGCATCTTTTGTACTAACC

ATGTTGTGTTTTTTGGATTGGTTGTAAGTTCAAAAGGAGTGCAAGTTGATGAGGAGAAGGTTACGGCTATTCAAGAA

TGGCCTACACCTAAGTCCGTGACCGAGGTGAGGAGTTTTCATGGCTTAATAAGTTTTTATAGACGATTTGTGAAGGA

TTTTAGCATATTGGCAGCATCTCTCAATGAAGTGCTCAAGAAAAATGTTGGTTTCAAATGGGGAGAGAAACAAGAAG

AAGCTTTCAATGTTCTTAAGTAAAAGCTAACTAATGCCCCCATACTTGCATTGCCAAACTTTCAAAAATCTTTTGAAA

TTGAGTGTGATGCTTCAAATGTTGGGATTGGGGCTGTGTTGTTGTAAGAAGGCCATCGAATTGCTTATTTTAGTGAAA

AGTTAAGTGGTCCTATCCTTAACTATTCAACTTATGATAAGGAGTTGTATGCCTTAGTACGGGCTTTGAAAACATGGC

AACACTACCTTTATCCCAAGGAATTTGTCATTCATAGTGACCATGAGTCCCTCAAATATATCAAGGGGCAAGGCAAG

CTTAACAAAAGGCATGTGAAGTGGGTGGAATTCCTAGAGCAATTCCCTTATGTTATCAAACATAAAAAGGGAAAAG

GTAATATTGTAGCCGATGCTCTTTCTCGGCGTCATGCATTACTTTCTATGCTTGAAACATAATTGATTGGTCTTGAAT

GTTTGAAAAGCATGTATGAAAATGATGAAACTTTTGGAGAAATTTTTAAAAATTGTGAAAATTTTTCAGAAAATGGT

TACTTTAGACATGAAGGCTTTCTTTTCAAAGAAAACAAATTGTGTGTGCCTAAATGTTCTACAAGAAATTTGCTTGTT

TGTGAAGCACATGAATGAGGTTTAATGGGGCATTTTGGGGTCCAAAAGACTCTAGAAACATTACAAGAACATTTTTA

TAGGCCTCATATGAAAAAGGATGTGCATAAATTTTGTGAACATTGCATTGTATGTAAAAAGGCAAAGTCTAAGGTAA

AGCCTCATGGATTGTATACTCCATTGCCAATTCCGGAGTATCCTTGGATTGATTTATCCATGGATTTTGTTTTGGGGC

TGCCAAAAACAAGCAGTGGTAGAGATTCCATTTTTGTGGTTGTTGATAGGTTTTCTAAAATGGGTCATTTTATTCCAT

GTAAAAAAGTTGATGATGCTTCCCATGTGGCTGATTTGTTTTTCAAGGAGATTTTGAGACTCCATGGTTTGCCAAGGA

GCATTGTTAGTGATAGGGACTCTAAGTTCCTAAGCCATTTTTGGAGGACTTTGTGGGGCAAGTTGGACACTAAATTGT

TATTTTCAACCACTTGTCACCCACAAACCGATGGGCAAACGGAAGTTGTTAATAGGACATTGGGAACTTTGCTTAGG

ACAGTTTTGAGGAAGAACTTAAAAACTTAGGAAGCTTGTTTACCCCATGTTGAGTTCGCTTACAATGGAGTTGTTCAT

AGCACCACTAATTGTTCTCTTTTTGAAGTTGTTTATGGTTTTAACCCACTAACTCCTCTTGATCTTTTGCCTATGCATA

ATGTTTCTGTTTTTAAGCATAAAGAAGGTCAAGCAAAGGCGGACTATGTGAAGAAGCTTCATGAGAGAGTCAAAAAT

CAAATTGAGAGGAGAAATAAAAGCTATGCTAAACAAGCAAACAAAGGGAGAAAGAAGGTTGTCTTCGAACCCAGA

GATTGGGTTTGGGTGCACATGAGAAAAGAAAGGTTTTCGGAACAAAGGAAATCAAAGCTTCAACCAAGGGGAGATG

GACCATTTCAAGTGCTTGAAAGAATCAATGACAATGCTTACAAAGTTGAGCTGCCCGGTGAGTATAATTTTAGTTCC

ACCTTCAATGTCTCTGACTTATCTCTTTTTGATGCAGATGGAGAATCCGATTTGAGGACAAATCCTTCTAAAGAGGGA

GAGAATGATGAGGGCATGACCAAGAGCGAGGGCAAGGATCCACTTGAAGGACTTGGATGACCTATGACAAGGGCTA

GAGCAAGGAAAGCCAAGGAAGCTCTTCAACAAGTGTTGTCCATACTATTTGAATACAAGCCCAAGTTTCAAGGAGA

AAAGTCCAAGGTTGTGAGTTGTATCATAGCCCAAATGGAGGAGGACTAAATGGCACCACTTTGTCTCAATTTTAGAG

-continued

TGTTTAGTTTGTCTAAATAATGGCTCAATCCTTGTAAAGTTGGCTGACCATAAATATGTTTTGGGTTAATCAACTAAA

AGGACTTTAGTTTGGTTTAGTTCAAGTTGTAATAAGGGCCCAATTGGCAACCTAGGCATCAGCCTTTTAGGAGACCA

AATGGTGGCTGGCTTGATGGCTGTTAGGGGTGACTTTTGGTTGCCACAATTTAGTTACATTTAGCCATTAAGTTCTT

TTAATTCCATAGGTTAGTGGCATTAAGTCTTCAATTATAGGTTAGTGGATCATTACTAAAATCTGATGTAAAGCTTC

TATATAAGCTGAACCATTTTATCAATAAACACAAGTTTAGTTTTATTCAGAAAATTAAAGTTTATCTCTTTTATCTTAG

TGAGAGTGATTCTCCTAAGTTCTTGAGTGATTCAAGAACACCCTGGCTATATCAAAGGACTTTCACAATCTTTGTGTG

TTGCCCTCGCCGGAAAGAGTGATTCTTTCCTTCCTCATCTTCAACCTTGTTCTTTCAAACCACAATTCCAGAAAAT

CCACTTCTGCCCATAATTATCTCGTGGCCATAACTCCTGTTTTACGCGCTCAAATTAAGTGATTCTTGAGCCTAAATT

GAATTTCAAAACGAGATCTTTCACCTCGTTTTGGAATCACCTCATTTGGAGCCCTGTATCTTGAGTTATTGCCATTTC

TATATTTCTGTCCAACCACCACTTAACCTACGTTTTATCATCTCATTCTTCCATTTTATGCCAAGAATCACCTTATTAA

GGCCAATGAAATTAGCCACTGCTCAACCCTTAAATCTTGCCAATTTCCATCCTCCTTAATCAATTTCCGCATTTT

CCATCAAGGTTTAATCCTAGACGATCCTAAGTCTTCCTCTGTGCAATGAAGGTTCATATCAATGAAATAGCCTCTCA

ATGCATAAAACAAAAAGGTAAGGAGAGATGGGATCTCCCTGTCTAACCCCTTTTTCTAGTCTAAACTCCTCTAGAGG

TTCACTATTCCAAAACATACGTATCTTGGATGAAGAGATGAAATGCCAAATAATGTTCACAAAGTTCTTTGGGTACC

CAATATCCTGTAAAGCATCTCGAATAAATGCCCAATTCAAGCAATCATAAGCTTTCTCCAGATCAATTTTTATTGACA

TCCATCCATTTGTAGTTTTTTGTGTCTCATTGAATGAAAAACCTCTTGGGAAATAATTACATTATCTCTACTCTGATGG

ATGGGAATAAAGTTGACTTGACAAGGGCCAAGTAATTTCTCCATCAAGGGCCTTATACAATGAGAAAGAACTTTAGT

GATAGCTTTGTGGAAAACATTACATAAGCTAATCAGTCTGAAATCCTTCAATCTAGTCATATGTTTCACCTTGGGGAT

AAGAGTGATATGTGTATCATTAATCTGATGCACCAATTACAGATCCTGAAACACGCTTTGAACCAACTTGACAAGAG

CATCCCCCGCTGTATTCCATTGACTTTAATAAAAAAAACTGCATGGAAGCCATCAGGGCTAGGAGCCTTAAATGCTC

CCATATTCCTAATAATGTTAAGAACTTTTTGTGAAGACACATCAACTCCAAGGGAAAAAACAAATTCCTCATCAATT

AGAGGAAACATACTTGTTACAGGGAACTCATCAACACACTGATCATCAACAAATAGGTTCTGGTAATATTGAGTCAC

CATACTTTTCAAAGATTCCCCATCCGAAACCCAGGTACCATCTTCTCCCTGAAGAGTCTCAACTCTACTCCTTCTCCT

CATAATAATAGTAGTTCCATGGAAGTAACTTGAGTTATGATCCCCCAATGAGAGCCATTTGGAATAAGCTTTCTAGA

ACCACAAAATCTCTTCCTGTAGCATCACAACCTCATATTCCCTCCACACAGAATACAACATATATGCCTGGGTGGAC

TTATCCCTCTCACCCATCCACTTGTTAATCTATCCATCCGCCTGAGAAGGCTTCATTTCTTAGAGAAAAAAAATTCC

TAAACACATTTTATTCCAATCTTGCACATCTTTTTGAAACAAACATAACATATCAAACCAAGACAAAAAAGAGTTC

CAATGGGAATGCACAAACCTCTTGAAATCATCATGAGTAATCCATGCAGCCTAAAAGGTCTTGTTTGAGAGTGATGA

TTCCTTTCCACCTCTAATCTAACCAAAAGGGGTCTATGATCCAATTTAAAAGGGGGAAGATGCAGCATCACAGCCTC

TTGGAATTTTATTCTCCACTGCAAGTTAATCAAGAGCCTATCCAACCTCTGTTCAAGGTTGCCTCTTTTCCAAGTATA

TGGTTACCTTTGAAACCCATCATATATTAATTCACAGTTTGAAATCATCTATTGAAAGCTTGTAAGATCACAAAGAG

ATGGATTGTCAGCACCTCCAACCCTTTCATGTGGATGAAGAATGGAATTGAAATCACCAATGATAGGCTATGACTTA

TCAATCTCACAAGCTAACTCTCTCAACACATCCCACATACCCTGCCTGCACTAGTAATGAGAACTATTATAAACCAC

CATTAATAACCAATCATTAGAACTCTTCCAACTAACCTTCAGATGCACATGGTATCTAGAATTTCCCAGCATCTGAA

CCTTCCATAAGCTTGAATCCCACAAGCAGCAAATACCACTAGAGTGGCCCACAACTTCTTCCACAACCCAATCCTTG

GATAATTTTCGTGGCCCTTGCACCACTAGAGTGGGTCTCCATAAAAAAATATTAAAGAGGATGGATATTCCCTTTTGA

TATCTTTAATTAAAGAAGCAAAAACTCTATTGGACATACTGTGACAATTGCAAGACAAAAAATTCATGGAGGCATAG

CAACATGGATGGCCTTAACATGGCCTTGGCTACCCTCTTGGCAAACTACCATATCATCATTCTCATTTTTGAAACTAG

CATTACTACGACCACCTTTAATTTGTGCCTCACCAACAATGCTTGGGTCAGTTGGCACAACTTCCTTTTGCCTCTAAC

GCTAAAGACTGCTTTCTATAGAGCCTTAATCATTTTAAGCTCTTAGTCCCTATCAATAATCCTTCCCTGTGGTGGTTA

-continued

AGAAGGTTCTTGACTCACTAAGCTTAAAACCTGTTTTCCCTTCTTAGAGGCCTTCCCTTTATTGGCAATTCCCATTTT

AGTATTTCCCTTTATTTGCTTTTCTTTCGGCTTCCTTAAAACTGGGCCTGTGTTTTTAGTTGGCCCAGTTTTACCCTCTT

CTACCACATAGTTCGTCTTCATCTCCTTAAAAACAACTCCCCTATTCTGTTTCTGAACACCCTTTGGGCCACTAGTGC

TAGGCCCATTAGCATTACGCTTAACTCTAGAGACCAACCTTTCCTCACGTGCTTCATTAAGAGCAATGAATTTTGAC

CCAAATGATTTGTTGTTGCGATCCTCACATCCCTGTGCTACAATCTTGGTATGATTGGCAAGGCCAACCCCATTAAA

GAGAACTTTTAACTAATTCTTCCTCACACTCCTACGCACTAATTACCAAGGCCCGAAATGATTGGCATTATCATTACT

CAAAACATTCACTTGATTTTCGTTTTCAAATCTGGACCATTAATATTATTCATTACGCCATTATCATGCACACGCCAC

CCTGTCAACTATCTCCACCTTAGCCACCATATATCTCCACCAGTTTTTTCGTCCCTCGGCTTTTGTTGGGATTGGATAT

CCACAACATCGGCTTTCATCTCCACAGAGTTTGCATCCTTGTACCCATACCTCCCACAATTAAAATAGATCAAATGC

AATCCTTCATATTGTAGATTTAATAAGTAACCTCTAGCAATAATCTTAGGCTGCAAAGGTTTGAATAGATCAATCTCA

ACACAGATTCTTGTGAAACAACCCCTTGCTTGGATAGTCATCACTCTGTCGATTTTAAGCATTACTCCAGGAGTAGA

CCCTAATCTCCATAAGAATTGGTCGTTGAACAATTCAATAGGAAATTTTGGGAACCTTATCCACAACCATCCTCCTT

CCGACATGCAGATTACCCAAGAGGAAAGGACGCCATCTTTACACCAGAATATAATGATCAACCACCATCCATGCCG

CCCCCCCCCCCCCCCCATGAAAGCATGGTTGTAATCCTCACCTCATCAGATGTGAACAAAATCTAATAGTAGTTTCT

TGGCACATCAATGATCAATGATCTTGATAGCACCATTCTTTGCCCACTCACAATTAAACTTGGCCTCCTATTGCTGAA

AACCCAATCTCTTCCCCATCACCATGACCATCAAGGACCCCCTTCCATGGCTTACACCAGTCACTAAACTCCTTATC

GGAAATAGGAACTTCTGGGAAACGTTCAAAGTCCTCCTTAGATATTGGCGTAGGAGGTATTTTCTGATCTAGATACC

CAAAACATCTCCCATCAAAAGTTGAAAAAGCCATTGGACCACCATTCTTCAAAAGCTTCTCTCTATACGTACCATCT

GGCACACCTTGCTCGGCCTCCTTATCTTTATCAAGCTCCATCTCCGAATTACCATCACCTTCCTCATTAGGCTTCCTA

TTGACTTTCCTAGTACTACGCTGGATATCATCTTCCTCCTTAGAGGATTCAGAAGAAACCCTAGTAGAACTCTCAAC

ACCCTCGATTACAAATTATTTATCCCTAGTGGGTTCCTGATGGACATTAACATAGCTATTCATTTATAAGTTACACTT

ACATATATTTGCAAGGCATCCATGAATATCTATGGATATTTCCTAAAACTTAAAATATAAAAATAAAAATAAGCAAC

TAAATTATTTTATGAGCTCTGCACAAATAGGCGCTGCAAATATCACTATAAAATGATAAATTAAAGAGTTGGGGAAA

ATAATCACTTTCACAATTTTTTAATTATTCTTCTATTTTTTTTCCTAAAAAATAGTTTAAAAACCCACAAATTTACAT

TCCTTTTCTCCCATATAAGATAAATGTATAAGATTTGTCATATTTCTGGAAAAAAATGAAATTATTCAAATTATCTAA

AAATTTCTCTCTTTAAAGTATAAATTCAAATAAAACTACACGTCGAAACATCAATTATTTATAAGTATATCCATATTA

ATTATTTATAAGTAAATGCACTTTAGTGGTAGCTGGTATCTATGAGTATATGGATAGTATAAAATCCGTTCCCGTTCC

ATTTACAAATAGGTTAAGAAAAAAACCTATTTCAATTAATTATAAATACTCATTTAAATATTCATTTTTCCGTGACAA

ATTTTACCTGTGAGTATTCACGGGTACAAGTTTTGAAGTCCTTGCATTGGTTTGCATCTTTTACACGTTTTTTTCTTTC

ACAAAAAAGGTATTTTTTTAATACACATCTTTTACAAGTATTTAAGGATTCGTATCAGTTTTTGTCATAGTAGTAACT

ATTTAGTATCTTTTTTCATTTAAGCTGTCCTCTGCTTATTCATGATAATGACGGCTAACTGTTAAGTTTCTTCTTGTAT

CTGTTTTTATTTTATTTTTTCTGACTTTGCCCAACGGTTTATGATTGCCGAGCTGCTATTGGTTCCACTAAGCTTGACC

CTGTAGGAAATATTTTCCTTTTTGCTAATTTGGAATTATGACTATTGGTCCAAACATGGAGATAAGATCATTGCATTT

ATCCATTTATTGAGATTAATTAAGTCTAAACATAAGTTGAAATCTGCCCATGCAACCAACGTCCTTTCATTTTTAAA

TAATGACATAATATGTGTCACCGTCGTTGCTCTCAAATTCAATTAACTCAATTGAGTGAATAACCAAACAACTCGAC

TGGTAACAGTAACATCAGCTATGTTTCAATTTCAAAGCCTTCTATTCTTTCGAAATCGTATATATATTATGTTCGCCT

ATTTTATCACGACAACCTTATGCAGAGGGTTTATTTTGTGATGTACGGAAAAAAAAATTATTTATTCCATGACTTTAA

AATAATTATTATTTTAGATTATTTTATATAAATAAAAATTAATAAATAGATGAAATAAAATAATAATTTCATAAAATT

CGGTATCTTAATATTAATAATTACTTTAAAAAATTAAATATGATATTTATTTTTGAGATAAATTTATTTTCAAATATAAT

ACTTATTTTAAGAAAAAAATACCTATTAATTATTTCCCACACAGAAAGAAGCAGACAAAAGTGTTCAAACGATGCAT

-continued

ACATGTGGCTGGAAATAAAATATAAATAGGGTTATTTAAACAACTCTTTTTCTATGCTTTTGATTATTGATTAGTTTC

GCACCATTTCTGGCTTCAGATGATACTTGGGGTGTAGATATAAGGGGAAAATAAATTGGGTTGATTAGGTCTAAATA

TGTATTATCAGGTTTCAAATTATAGTTGGTTTCGTTCGGTTTTTTTGGGTACATGGCTTGTTTCAGTTTAAATCTGAAT

ATATTAAAAAGATTAAAATAAATTAATTAATTTGATTTAACATTTTGATTTCGTAGAACTAAACTAAATTAATGAACA

ACCTAACTTTCAATTAGGGTATCTTTATGCAGGACGGAACGATAAAAAAAAAAATCGAGGAGGGGCAAAAATTTAA

AAGCAACCATAATTAACTTTTACTATCAATAATTATTTTAAACTTTCTTTGAAAGAATAATTATTTAAAACTTAGTCT

ATTGAAAAAACTAAAATATCATATATCCCATTGTTATATTTTAATTGTAAAATAAAATATAGTGAAATAGAATGGTGT

CTAAATAAGTTACTATTTCATTGTTTAAATATTTTTATGATGAAATGAAAAAAAAGAGTATTTCTATCTCATCATTCTT

TAATTAAAGGAAAACATATAAATGTAAAATAAAATAAATATATTTTATTTCATTCCATTTAAACAATACAGTTTATTT

TTTATTATCGTCTTATTTTAATGTTATTTTGAATAATTAAATAATAAAGTTTGATATCATTTTATTTTATTGCGCTTCAT

TCTATCTTTCTTTCTTTTTAATCAAATTAATCACAAGACTATGGGACCACTTCCTTTTTCCTTAATTTTCAATTTTTGCA

TGCACTTTTACAGTATGAAAGGCATAAGAGAGAGATTGGGGAGCTGCAGCTCCCTGTTGGACCATTCCATCAATCTT

CAAATGTGGAAAAAGAGGTTTGTATAATGTTCTTTCTTCCCATTTTTATTTGTAGATTCCATGCTCACATGAAGATTA

CTTTTATTATATCTATTGTTTTCCTTTGTCATTTGAACTTGAATGAAGCTCCTTCTTTCTTTTTTTTTTTTTTTTGTGCAC

ACACCACTGCAAGAAAACAGAGGCACCCAGATATAACTATGTTGCTGCTACGACTGGAGTTTGAGTTCTTCATTTTT

TTTTTAGATAATTTTTTTGTTTTTATCTCTAGTTACTGAAATTATCCGAGAGTCTTCATTATATACTGTTGGAGTTTGA

GTCCTTCATTATTAAAATAAATTCTTGGATGTAAGTGATGATAGGATAAATTGTAGCCACACCATTATTTTATTCTC

TTCTAAGCAACCACACGAGATGGGTTTCATTTCCGAATTTTGACCCTCCCATGTATTAATAAGTTACTCTTGACAAGT

TGTTCGTATATAAATCTACTGATTACTTAAACTAGGGAGTTGATAACATATAGATCTACTTTAATTACTTAAGCTA

GGGAGTAGACACTAGTTATTTTTTCTTTCTTTCCATCAATCGTCAATGTTTTGGCTTAAGGCTACCAGAGATAAAAAA

AAAAAAATGACAGAATCGAAATAAATAAATAAAATTAAGCAACAACAAAAAAAAAAAGAGATAATACGATGGTTC

TTAAATAACCGTCTTAGAATGTCTTACTTTCTAAGCCGGTTATTTAGGAACCATCTAAAATGTCGCATGTTGATCAAA

ACATACTAGGACGGTTATTGAATAATCGTCTTAGAAAGTAAGACATTCTACGACGGTACCTAAGAAATAGTCTTAGA

ATGTCTTACTTTCTAAGACGGTTATTCAGTAACCGTCTTAGATCCGACGACATACTAAGACGGGTTGTTACTCTAAAC

CGCCTTCGAAAATGGATCATTCTAAGACGGCTGTTTACTAACCGTCTTAGAAATCTATATTTTCTAAGATGGTTGAAA

AACCGTTGTTATAAATATGATGCTATTTTATGATGTTGTATTCTATGACAGTTCAAAACCGTCATAGAATGACAAATT

TAACCGACTTAGAATATCATATTTGTAGTGGTGTTAGGCTAATATTTCGAATGATGCTACTTGTTTTCCATTGTCCAA

CATAAAAAAAAAAACCCAAACGTTAGTAATATAGGAAAGAAAAAATTAAGAATCAAGGATCAATAATAACACCAC

GAGTCAAGACATTTTCATGATTTTATTTGTGTATTTTTTTATGATTATCCAACTGAAAATATTAAGCAATACTAAGAA

ATATCTGGCAAAGCTTCTTAGTATATAATATGAATGACATTGAATTATAAGCAATTTAATAAGCCTTTGCCTGAGCCT

TTTTCATCTTCCAAGACTCGGTTGGATTCTGACTTGTAGAACATGGAAAGAAGAAGGGTTCTTGGAATCATTGGACTT

TGAGAATGTGGAGACATGAGAAGCATCAAAGGAGGATCAAGAAGAATAGATTGTCGATCTTTCCCAACTTTTCATA

GGTAACAAGTTAGCATCCGGTGGTCATAGTATTAAGCTCTTACACTCTATAGTACTGGACTCAATTGTGAGCCTGTAT

ACAAACACATTAGATGGTTTGTTTGTTTAGCTTTATGGCTTTTTGTTTGTGTAGGAAAACACGAATTCAACTGTTTTG

AGTTCAAAACTCTAATATGCCTTTCCTTGTTTTATTTTGGTTATGGTTTTTACTTTTTTCTTTTTATATACTCACTGCCA

CTTTAGTGTTTTGATGAAGGATAGCATTTGGTTTGAGCTTGAATATACAATATAAATAATCAATAATTTTTTTTTGTTG

TTTATAATAATTTTATCATGTTCAATTAGAATTGTCTTCCCATGATATGGTCAGGGAGCAGAAGGTGAACTTCTGAAA

TCTCAAATAATAAATAGCCTTACAAGACACCAACTTGAACTATTTTTTTTTCTTTCCTTTTGATTTTTGTCGTGTATTT

ATACGGAGTACAACACATATAATACTATATATATTATATGCATATATGTGTGTGTGGTCATACTTGTCAGTTGCATTT

ATTATCTTGAACTGCAGGTGTGTGTGTATTTCCATATATATGAATACGAATGGGTCTTAATTTACACTTTATTGCAGC

-continued

TTGTAAAAAGCTGTGGGTGTACTGTATCATAACAAAATACATGTCACAAGGAACTCTGAGGATATATGTATCCGAAC

AAGAAAGAGTTGTACTCTCTTTCAATAGAAACTATACTAATGTTAGCTCTTTGACATACTTAGGGGTTATGGAGTATAC

AAGAACAAAGCAACATGAGTTTTTAAGAATAAATCTCCATTGACTTAGTAATGCCACAACACTTAAAGAGTGTCTAC

CTAAATTTGATGTTCTTGTTTCTACAACTTGTAAGATGTCATCTCATTACTTTCAAAACTGTCACTTATAAACCAATGT

CAAAAAAAATATATCATTGTATAGTATATCGCTGGAGCGTGCATAACATCAAAAGGGACTGAGTTCTTGGTGAGGAA

CTCTGGACAAATGATTAACAGACCACAGAGATTTATGTTGGCTTCCCAAATTTGCTGAAGCTTTCAGAGATGCCAAT

TTCTGGAGGTGGCTAAACAACTAGTTGAATGACGACATTAAAACAAATCAAGCAGTAGTATCAATTGTAGCTCATTA

TTTGGTAAGCACAGACCAAAATCATAGCACCTATCAAACCCAAATCTGAAAAAATGTAGCATTTGTACAAGACATTA

TACAATGCTACTACTATGTATGTTTATCATTTTCACTCTGAATTATATTTAGCAGTAAGTCACATGGATTTGGTAAAA

AAATAAGGGGGAAAATGTAACGTGTGTGTAACAGCATGACTTTGATATTTACCCAATTTTATATTTTTCCCTCCAGCA

ATAATCCCCAGAGACAAAACTTCAAAAATATTTCAGTATGAAATTGCAATAATGAAGATCAATTATTGTTAGTGGAT

AAAAAAAAAAGTGGGTCCCACACTAATTTTAAAATTATCCACACAAAAGGAAAAACATGTTATTTATCACATTCTAT

TTTTTTCTTCTCCCTTCCTTGTATTTTTCAGCTGAAACAAACACAATGTTACATCTTTGTACAATTTCACTTTTCCTCTT

GTCAAGATTAAAGTCTAGGAATGCTCATGAGTCAGTTGGATGAGACATGATAAGTTAAAGTTGAGAATTTACAGCTT

TGTACATTGTCACTTTTCCTCCTGTCATGATTAAAGTCTAGGAATGCTCACGAGTGGATTGTTTGGATGAGACTTGGTA

AGTAAAGTTGAGAAGAACATTCGAATGTCTGGTACAATGCAGGAAATCATGCGATAATACCCGCAAATTGAAAAGT

TGGCGACATAAATATGATTGAATGCTCCCAGCCACAGATAACAACAGTAAACCATTAAAGTACTATTCGGGCGGTA

AAAATTTAACATGCCATGGTTTCGACCTCAGTTTAAAAAAATTCTTCAGCATAAACAGTATACATGCATGTTTTAATG

TAGTAACATTTGAATTCTTCGACATCTGGTAAACTGTTTTAACATTTTCCACATATATATCCCACAAGAATAGGTTGG

TGAGCCATTGGATAAAATTAAGCCATTGAAAAGCTTTCTACAAAAGAAAAAGAAATAAAAATAGAAGCTTTTATCTA

CCTGAGCAATAGCTTCTTCACAAATACTCTTAAGGCCATCCAGATGATACTCATATGTAGCCCTTGAGAGGTCCTAA

GCAACATCCAAATTAAAATATCAACAATTCAATTTCAAAGACAAAAGGTATTATACTAGTTTAAATAATGCAACTAT

GAAAATGTAGAACAGACGGTTCAATGAATAAGGAAAATAAATCAAAATAAACAAACGGGAAAAGCACACATATGA

GTAAAAGTACCTGGGGAGTTGGTAATGGAAAAGCATCAAAAGGAGAGACTAAACAACTTGCTTTGGCAGCCAATTT

GTGAAGTGCTGCTGAAGCATCACCCTCTCCTACGCCCTTCTCGCTTGAAGATTTAAGAATATCCAATAGCAATTC

TAATCATGTACATTTAGCAGCATATTCATTGCAAAATACTTTTACCATCATGAGGAGAAGAAAAAAGTTTAAAATCA

TTTATTATGAAAGAACATCCAAACGTTACAAATCATTTATTACCACTATTGTCAATGAATATAGTTTTACCATCATGA

GGAGAACATAAATAAACAAGAGCAATAGTTACACGTATTTGAAGCCCTTTTTCTAAAAAGCACATAACAGAGATTA

GGTGTTCCAATACCTGCCAAAGAGGAATAGATACAAAAATCATATCCAATAACGTAAAAAAACATGAAAAAAATAT

CGTTCAAAAACTATAAGTAGATTATAATTCTCAATTTCACATCTATAACTAAACTAAATCACTCACAGAATTTGCAC

GAAAACTCACTCGCCCTTGAATCTTCTTCTCTAATCTTTTTAATGTGTTTGCTATGCAATCTTTCATAGGCTGCAAGTT

AAACGACAATCACAACAAGGTGTTCTGTTAAGGAACATTAATAATGACTAAATTATAATTTAAGAAGAAATGCAACT

ATATATGGTAAAAATGAAAATCTATTACTTTAATTACAAAGAGTAGATGAACATACAACTAATCTTTAAAATGTCCA

TCCTTCGGTTTTTGAAAACCACCAGCCATAATAATATCTACAACAATGTCCTATAATACAAAGATGTTACATCAGTG

GCCGCATATCACATTATCACTGCACATCGATGATTTCTAAAGGGCAGCACACAATGCTGACAAAGTAAAGAACAAG

GAAATTAACTTCACCTCATTACCAGCAAGACCATAGAGGGCTAAAGTAGCATCACGTTGAAGGGGAGAATTGTTTG

AGTCAATAATATTGGGCAAAGGCTCTATAGCTCCATTTTAAGCAATAACAGCTACGTGGGTCCTGAAATTTGAATTA

TATATGCAAAAAAGGGTTATGGAAGGAAAAATTATAAGAGGAAAAACCAACATATATATATATATATATATATAATT

CGTGAAACAAAGGAGCATATTTTTTTTACACCATTTGTATACATTTACCTATAAATTAAGAAAAATCCACCCTTAAG

AGTTAGGTTTAAGAAAGGCAATCCCAAATTCAGCCATAACTAATGACTGTAGTGTTAGAGGAATCCTAAAGCCTACA

-continued

CCATGGAGTCCCCATTCAACATTAACCATTTGTAAGATTGTGTAGTTATATTATGAACACAGCCAAAGGATGGCAAT

AAACATGTTAATAATTGAATAGAGACTATGATTAGCAATCTATACCTAAGAATAGCATCATGGCTTATCAAATATTA

ACTTTAAATAGGAGATTATTTGAGAATTTTAGATCAGGCTAATTAATTACTGCTATGATAATAAAAAATGCAATTTGA

ATTTTTAAATTTTATATTCCTTAACATATAAGCAAGCGACTAACTTTTTGTTGCTACTAATAATCACCTGTGCCAACC

TCCCAATTGCAAAAGCCGACATTTCCCGGAGCTCTACATGTGGAGACTTAAGCATGTAAACTAATGGTGGAATAGCC

CCTCCTTGGGAAATATGGAACTACCACAAAGTATGGAAGTCAATAAGAGGATTTCATAACTCATAGATTTATCATAT

TACAAGTTTGCAATGCAGAACTTAATCCACCTTTAAATCTGAATTTGTTGCAGCAAATTGACCAAGTAAAAGGGCTG

CTTGTTTTTTGCTTTTCAAACAACAAGAACTATCATTGAAATTATGAACTTGCAAAGAATACTTGGGGGAGAAAATA

ACTAAACCATTAATATGAAGGTAGTATCTGATTTTCAGTAAACAACTATAATGTTCAATAAACATATCATTCTTCTAT

ATATGGATTGCTTAATGATTAAAGGAAAAACCATGACCAAAGTATAGTGTAACCTAAGTAAACAAACGACAGGTGG

TAAAGCCCCGGCTAGAAGCACTTCTTTCATAATATCTGGTGACGAGTGGACCAAATTTTCAATAACAACAACCTACA

AAAGGCGCTAATACAACTAGTGCTAGTAGTTTAGAACTCTGTAGAAGCAAACTAAAAAATGCATGCGATTGTGTAA

AGTCATATAAGCATCTTACCACTACATAACGTATTATAGGATCCCTGATTGAAGCATTAGTACAAGAGTGGGTAAT

GCATTGCATCCAACAACCTGCAATTTTTTTATTGCAGAAAGTCAACTACCTTTTTTGGCATTGAATTCAAGCAATTCAA

CAAGAGGAGGGATATCACCTTCCTTCCAGCATATACCATACCTATATAAGCATAAAGAATAGAATAGTTGTAGAATA

AATATTTTTAAGCCATGAAAAAAAGGACAAAATCCTGACACGGGTCTTATTGGTGGTATTTTCAAAGTCAAGATTGC

ATATTGCATCAGCTACTCTCCTGAGAAGACCGATAACTGGAGGAGAAATGGTACTGATCTTGTGCTTACTTAACAAA

TCTACAAGACAAGGCAAGGCTCCAACATCTATAATGAGTTGTTGACGCTCTGGTTGTTTGATGATAAAGATAAGAAA

AAATTAAAATCAGAGTTAAGATGCTCCATGATTACGAGGGATAAACAAACGTGACTTGAAACTGATTTTATTCTTAA

ACATATTTTTGGAACCCTCGTACCAGAAATTCAAAGACACCCATAATCATTTTCCTCTAAAAAAGGGCCACACTATT

ATATACTACTGAAAACTCAAATAGAAAACACATAGAGACGTTACATGCACGCAGTATGGTTGATGTATTTAATCCAA

TACACCCATATTCTTCACTTATATGTTAATTTGGATAGTAATTTGTATTATTATTTATTTCAAAAATCACCCTTAAAATT

ATCAAGACTCTCCATCTCACTTTTTCATTTAATTAATTAATGTGTGCTAGTCATGTTATTGGATGCATCCAAGATTTCA

TGGGCCGATAACAAAAAAAATAATTTGTACCCTTTTATATTTAAGTATTTGAAAATATAAAGATATATTATTTAAAAA

AAGTGGATACATAGTTTGATTAAAAATTACATTTTTTTACATTAAACAAATAACATAGGTTTAATGAAACTCAAAAT

GATATATATATATATATATATATATATATATATATATATATATATATATATATATATATATATATATATATATATATAT

ATATATATATATATATATATATATATATATATATATATATATATATATATATATATATACCTATAGATATCCAGATATA

TCTGTATCTCCCCCTCCCTCCCTATCCATTTTTCTATATCCACCCTTCCCCCCGCCCTTTTTTCCCCCCCTTTTCCCCC

TTCCCCCTTCTCGCCCCCTCTCCACGTGTAGGGACCCACCTAGATCCAGTTATGCTCTAGCACCCCCCCTCCCTGCGT

CTTCCATCCTTTTTCCAGCGCCTTTCCTCTTTTCCCCCCTTTCCCCCAGCTCCCACATGCACCCCCAGGGGCGGCCCT

GTCTCTCCCCCGCAACTTCCCCTCATTTCTCGCCCCTACTCTCGCCCCGCCCTGGCGACGCCCCCCTCCCCACCCCTC

GCCACACCCTCTCCGCTGTCCGCGACGTTCTCCTACCCCTTCTCGCCCGCTGGGGTGTAGACACCTCCTCTCCCCCC

CCCTCGTTGCCTCTCTTTCCCGCGCGCGGCTGTCTTTCTCCTATCTGACCTCACACGCTTTCCCGCAGGGGTCTTTCC

TTTTGTTCTCGCCCGAGGCCCCCTGGCCGTAATCCATGTGCCGCCTAAATCCCCGTTTGTTGCGCCCACGCTACTCCT

TGTTGCTCCCCCCTGATAACTGTTCCCCCCCTTGCCGCGCGGCGTATTATTACAATTCTTATGTCGTCTTGTCTTTCTC

TTTTCTCGTCCCCGCCCTTTAGTGTCGGCTAGTTGGCCCGCTTTTTTCTTCCTCTCTCCCCC

BAC99.FASTA.SCREEN.CONTIG6 (SEQ ID NO:182)
ATTTAGGTGACACTATAGAATACTCAAGCTTAGCCCTAGAGGGGATGGACCTTTCCAGGTTTTGGAGAGGATCAATA

ACAATGCCTATAGGTTGGACCTCCTAGAAGAGTATGGAGTCAACACCACTTTTAACATTTTTGATTTAATTCCTTTTG

-continued

```
AAGGTGGAGCTGATATTGAGGAGGAGGAACTAACAGATTTAAGGTCAAATCCTCTTCAAGGGGGAGGGAATGATGC

AATCCTCCCTAGGAAGGGACCAGTCACTAGAGCCATGAGCAAGAGGCTCCAAGAGGATTGGGCTAGAGCTGCTGAA

GAAGGCCCTAGGGTTCTCATGAACCTTAAGGTAGATTTCTGAGCCCATGGGCCAAGGTTGGGTCCAATTATCTTTGT

ACATATTAGATAGGATGTCATTATACTTGGTCCTTGTATTTAGGGCTCCATAATGTAGGTAGGATACCCTAGAAATA

TAGGATTTTTCAACCCTTGTATTTTATGGCACCTAGACTAGTTTTTGTATTATGGGTAC5TTTTGTAATTTCACATTCAC

TAAGTGAATATTTGATGTGTGTTGAGAAATAAATTTAATTGAATTGGTAGAAGCCCAATCCAATTAAATTTTAGAG

GGGGAGGTGAGCATTTGCTTACTACACCCCATTGCCACATCATATAGTCATACTTTGTGCATGTCCTTCATGCTTTAC

ATGCCTCATGACACCTAAGCACAATTAGTGGCGAATCTTGGAATTGATCTTGGATTAGTGGGCTGAACCATAACTGC

AATTCACTAATTATAATTAGTGAAGTTTTGGCTCCAAAATTTGGCTCCATAAATTCAAGTGAAATTTGAATTTCCCTC

CAATTTTGTGTGACACTTGGGCTATAAATAGAGGTCATGTGTGTGCATTTTTTTAACTTTGATCATTTGAAAATTAAA

CTTCAGATTTCAGAGCTCTTTTAGAGCACAAAAATTTTGTGCTCTTCTCTTCCTCTCCCTTCATTCATCTCTTTCTTCC

TCCAAGCTCTTATCCATGGCCTCCTATGGTTGTGAGCTTCTTCTAGACTCATCTTCTCCTTGAAGTGGCATCTTCTTTC

TCTTTTCCTTCTCCATTCCGCTGTCATTCATCTTCCTAGGCCTACAAGCTCCAATGGAGCTTACATCATTATATAAAG

AAGGAACAAGAACAAAATAGATTTAATATGTTTCAAGAATCTGCAATGAATAAAATCAAAGAAAAGAAATTTCACA

CACTAACAGAATCGTAATTTATATATAATTAAATTAATAACAAGTAATGACTAATCCAATTTAGTCAATGACCAATC

AATACATCTATAAATACAACTACTAATTCTAATCTTGGAGCCTACACTAATACAAAGATAGTGTAAATTAAAAGTCT

GAATTAAATTGGTAAAAACAAAATTTTTCATTAAAAGATGGGTGTAAGAGTTTTTACTCGCTTAAATTGACGGTTAC

ACAACCATCTTTATTTTTAAAAAACAAGAAACAATATTCCTAATAAAGAAAAAAGTCGCTTAGCATCAATAAGATCC

CACAATTGAATCCAATATATAAAAATGCAAATACAAGGTGATTATTAACTTGGGCCTGAGACCCACAACAACTAAA

TTAACCTATAACTCAAACCCCACAATATTAATCCATTATGTACCCAAACTACCTTTGAGTCCATCGGTAAGCAAAAA

AAAAAACAAACAAGGATCATTCACAGCTTAATTTAAACTTAGATTGAGAAGTTCACATGAATTATCAAGTTGGGCTT

AAAACCCCACGAGTACAAAAAAAAAACCAAACCCAATGAACACATTTTCCACCCACGAAGACAATACAAAGGTAC

TACACATTGATACCAATCATCCCCAAGCTTAGTATTCCCGAACTATGGATATGATATGACAGAGATACAAAATTTGT

GATTAAGATTAAAGAATCATAAGATTCAGCTTCTTCAACTAGCTTAGCTTAAAACCTTTTTGGACCATGTTTCGTGTT

AGGAATAGAGAGCACACTTTCAGTACGAATATGAGTCAGTTAATACACCAAACATCGCACATTTTCAAGAACAAAG

AGCACATTTTAGACATGAAGCAAAAGCATTTCTCAATGAACACATTTTCAGGTACTAACCTGGGGAGGAAGTCACG

AGGGAATTGGACATGAAACCAAAGAAGGCTTCAAGTCGCAAGGTAGAGATAATACAAAACAATGACGAGGTCGCA

GCAAAACATGGGTGAGGCAGTGACGGTGTTACAGTAGAACGCGGGAGCACCTTTGTAATGACCCGCCTCGTCGTTA

CGATATCACCACTCTAATAACTGAAAAATTAAATTCTTTTTCTTTCTTTTATGAAAACTCCATTATTTTTACTTATGAA

AATCATAGTAAATTTGAATTTCACAAATATATATATATATATATATATATATATATATATATATATATATATATATATATA

TATATATATATATATATTGTCCCCAAACACGCACCAATGTTTGACCGAATACATGAATATTATGTCATTCATCCAC

AATAGATATATCGCATCCCATTCGTTAAAAACATAGTTTTTCTTGAAAGAAAATCAGCATGCAATAGGGACATGCAG

ATATTCTCAGAGCTAGGTTCCCTGACCCTAACTATGGTGTCAAAATAGTAAATTTTATAATAACTCCCCTCACCTATC

GTGAGCTCTCCGTCAGTTTCTCTTTGCATCACTTAGAGGTCTCTCTCTCGTTCACGCTTGTCAGTCCAACGCAAGTCT

CTATTACACCAAAACAAAAGGAATTTAGCATAGGCTTCAAAAACAAGATCAAAGGAAACATTCGGGGTCAAATACC

ACTGTCAAAACATAAGGGATAGAGGGGTATTTCGGGTTCTACAGAAAAGAAACATCTTTTTGAAATTCCGATCACGC

CAATGTGACCGGGGTTTAGTGAATGCCGCAAAAATAACCTCAAGGTCATAAAAAGATAACTTTTACAATGTCTCATT

CTCTAGGATTTTTCAAAGGAAGTGTAAAAACACCCTATAACAGTACCCAACACATAAGAGACACTAAGAGGAACTC

AAACTAGCTAGGAGAAGGCTTAGAAGTCAAGGTTACCTTAGAGAAACTTTGAAATGGAGGATTGAGGGATTTTCTCC

ACCGAATTCTGAGGATTCTGCTCTGATTAAAGTGTTCCTCTTGGTGTGGGGGTCCAACGGCAAGCAACAGCGGCTCA
```

-continued

TAGCGGCCACTGGTGGTCTTGGGTGGTGGAAAATAAGGTTTTAGGGTTTGGGAGACGTTTTTGGGGGAAGAGGTGAG

TGAAATTGTGTTTTTCACGCTAAGGACGTATTTATAACCTGCAACATTTGCTTAGCGGGCCTTCTGGGCGCTCAGTGC

ACTTCCTCTCGGTTGGAAATGGGCTTAGTGCAGCTTTGGGCCGCTCAGCACAATTCCCCTCGGTTGGAATTGCGCTT

AGCGTGCCTTTCTCGCTTAGCGGGAGACTAAAAGTTATTATTTTCAAGATCCCAACGGTCAGACAGTAGGAACATAT

CTTAGGGATATCCAGACAAAATTTGAAGATGATGCAACAGTTAACGAATCTGGTGTCGCGATTTCATTGAACTAGGT

TTTGGTAAAATCTAAAATCTCATACTTTCAACTTAGCTCAACAAAACTCCACATAATTCAACATCCATATCAAGAAA

TTCACACATGACTAGTTCAAGGCATACTTCAACTCATTCAAGTCTATCATGTAGTCAAATAACACAACAAAATAATC

AAACATCAAATATAATTACTAATAATATATATATCAGGGTGTTACAACCTTCGCGAGTGATGGTGGTGAGACTGAGC

ACGAGGACCTTCGCGAAGGAGAGGACTGTCACGAGGGTGAGAGTGAGAGCTCTGGTGAAGGGTGAGAGTGAGAGC

GAGACTGAAGCGCCATGGACAGAGAGAGTGAGAGTGAGAAGCACGAAAGAAAATTATAAATAGGATAGCACAACG

TTGGTTTTTTCCAAAAATCAATGTTAACGCGTTTTGTTAACAACAATTTTTCAAAAAAAATGATGTTAACAAAAGTTC

ATTAACATTGATTTCTAAAAAACTGATGTTAACGAACTCACATCGGTTTTTGAAAAAACCGATGTCAACGAATTCAT

GTTATTTATGATTATGCCATCGTGTTTTCATTAACATCGATTGTATCGAAAAATGATGTTAGCCTAGCGATTTTAAAA

GTATATTTTCTAGTAGTGGGAGTAGACAATGGCCATGAAATACCTTTCCGACATTTTTGTTAGAAGCAGCGAGTGAC

AACATCGTGCACATGGGAAACCTAGATCTATTTTTTGAAGATATCATAATACCGACCATTGTTTCTTCTTTGTGACAC

CCCTATTTATCCTTCATAGGCGAATGTTGATGGTGTTGGATCGAGTGGCCTCAGAATAATTAAGAAGGGAGGGTTGA

ATTAATTATTCCTAAAACTTTACCAATTAAAAATTACTCTTTTAAGGCTTTTACTTTTGTTGTTAAGAGAATATGGAGT

AGAAGAGAAACTTAACAGAAAGTAAAAGCGAAAATTAAATGCACAACGGAAAGTAAAAGAGTAGGGAAGAAGGAA

ACAAACACACAAGAGTTTTTATACTGGTTCGGCAACAACCCGTGCCTACCTCCAGTCCTCAAGCGACCTGGGGTCCT

TGAGATTTCTTTCAACCTTGTAAAAATCCTTTTACAAGCAAAGATCCACAAGGGATGTACCCTCCCTTGTTCTCTTTG

AAACCCTAGTGGATGTACCCTCCACTAGAACTAATCCACAAGAGATGTACCCTCTCTTGTTCTCAGTCAAACCCAAG

TAGATGTACCCTCTACTTGTACCACAAAGGATGTACCCTCCAATGTGTTAAGACAAAGATCTCAGGCTGTTAAACCT

TTGATACTTTGTGAATGGGGATACAAAAGAATTCTCAGGCGGTTAAACCTTTGAACGCTTTTGTATTAGGGAATGGG

AAGAATCAAAAGAATTCTCAGACTGTGTCATTTTGAATTCTTTGACAAGGGAGAAGGGAGACACAAAAGAATTCAG

GCGGTTAGTCCTTTTTTCTTTAGGAAAAGGGAGAAGAGAGACACAAAAAGAATTCAGGCGATTAATCCTTGGCGAAT

GGCAAAGGGAGAAGAGAATGAAAAGGATGAATAGCACAGGTTTTCAAGGTTTAGAAAACCAAAAAACTTCAGAAA

GCTTTTTGGTACAAAGAAGAAGAAGAAGTTCAAAGAGATTCAAGGCTTGTAAAGGATTGTATGAATAATTGTTCAAGA

TTGTTGTTGGAAAGATTGATTCGGAATGCAAAACAAAGCCTTGCTTTTATAAACTCTTGATGTCTGGTCAAGAAGGC

CATTCAGAAGAGTTATAACTTTTTAGAAAAACTTAAAACCCATTTGAAAAAGTCAAAACCTTTTTGAAGAGTTACAT

CTTTAGATTTTTCAAAAACAAACACTGGTAATCGATTACCAAATATGTGTAATCGATTACACAAAGCTTTTGAGTGA

AACAATGTGACTCTTCACTTTTAAATTTGAATTTCAACGTTCAAGGACACTGGTAATCGATTACCAAAACATTGTAAT

CGATTACAGCCTTTTGAAAATATTTGGAACGTTGTAAATTCAGTTTGAAAACTTTTTCAAACTCATTTTCCTACTGGT

AATCGATTACAACAATATGGTAATCGATTACCAGAGAGTAAAAACTCTTTGGTAAAGGTTTTGTCAAAAACTCATGT

GCTGTTCAAAGTTTTGAAAAACTTTTTAATACTTATCTTGATTGAGTCCTTTCTTTATTCTTGAATCTTGAGTCTTGAA

TCTTGATCTTGATTCTTGAGATCTTGCATCTTGAATCTTGATTCTTGATTGTAGGCTTTCTTCTTGAGTCTTGAATTCTT

CTTGATTCTTGAACTCTTGACTTGTTCTTGATTCACTTGAGATGTTCTTGATTCACTTGAGTTTTTCTTTGATCTTTTG

AGCTTTTTGTTCATCACCTTTGTCATCATCTTTTGTTGTCATCATTGTTATCATCAAAACACCTTTGAATCATTGTTGA

TTCATCATGAAGCTTTGCTTCCACAATCTCCCCCTTTTTTATGATGACAACTTCAGAAATCAAGAAACACACACACA

CTTTTTCCTAGTCGATCACTCTTATAAATGCTCCCCCTTTGTTTTTGAATTTATGCTTATCTTAAAATTAAATTATTTAC

TCATGTGAGTTCTTGATTTATCCCTATTTCTCTCCCCCTTTGGCATCAACAAAAAGCCAAAGTGTGTATTTAAACTTA

-continued

AAGTATGCAAATATATCTTAAACATTCATACAGCATTCATAAAAAATATTAACCACAACATGAAGTAAAAACCATGA

AGTAACAATCATAAATAGATTAACTTATAAAATCCACATAGTCAAATAAGATACTTGTTCAACCAAACCATGCAAAT

AAGGAAATAATAAATTGTTCAAATACCATAGTAATATAGCCAAAATACAAGGCTGAAAATCAAAGTAGTAATATTA

AAATATAAGTCTAAGATGATGGTGGCGGCGGTGGTGGAAGATCAAAGCTTGACCGGATGTAAGATACATCTTCTTCA

ACCTTAGTCATTCTTGACTCCATTTCATTGAAGCGCATATCCACTTGCAGTTCCAAAGTATCAAACCTCTCACCAACA

AAGGTTTGAAGACCATCAAACCTTTCCAAAATCTTCGAAAGAAGAGATGAATCTTCTCCCTCATGACCTTCTTCACC

AATATTTCTAGCACCCTTCTTTACCCATGATCCATCATGCTCCTTAATATAACCAAAGGATGCTATGACTGAAGCGCC

TATAAGGAATGATCTCTTGATTGGAACATAAGGTTCAGAATCAAGAGGGATGTTGAAATGTTGAAGGAAGAGGGTA

ACAAGGTGAGGATAAGGCAACGGGGCATTCAATCGCAACGCCTTATGCATGCGATATCTAACAAGATGTGCCCAAT

CAATTTGTAAACCTTTATGAAAGGCCCACATGACAATGAGATCTTCTTCAAAAACCTGGGCAAGGTTTGAAGATCTA

GGAAGCAAAATGCGAACTATAAGGTAATGGAGGATGCGGCTTTCAAAAGCCAATGAACCAGCAAGAAGTCTTCCAG

TCATATCCGCTTGGTTGGTGCAAACCAATCGGCGGGCATCATGCACAGAGAAATCGAATTTCCATTCATCAATCAGT

GCACCCTCAAAAGTCATACCTTCACTAGGCAATTTGGTTAAGTCAAAAAACAGGGATTGGTCAATGACCATCTTAAT

CCCATAGATTTCAGACATTAGAACACCTTCATGAATTTCTAAATTAGAATAGAAGGCTTTTGTTAGTGCTTAGCTTTA

CTTAGTTTTAAAAGATTGGCTAAAATTTTGTTAAAACATAAAGCACTTAGACAATGAAGGAAAGCTGGAGTTGCTGC

ACATGATGTCTAACATTATGTCAAGGAATCAGATTGGGGTGCACAATGCACAAGGCAAGATAAAATGTCAAATGAA

GAATTGAAGCTGCAGGATCCACGATGTCGGATACAATGTCCAGGACATCCTGCCCGAAAATACTGGACACATAAAT

CTGTTATATCTTTAACAGATTAATGTGCAGTCAGCAACAGATTAGGAGCTCTATCTTTAGGAACGAATTAAAAGATA

ATTAAAGATTGAATTACAAACTTGAATAGTTTCGTTCAGGGATTAGAGATTGAAGATAAAAACTAAAAGATAAAACT

TTATCTTTAGATCTTTAAGTGCAGATTTTTCAGGAGAATGATAGAGCTTATCCAGCGGAAGTTGTTGCAGCCCAGAT

ACGTACACTGCTATATAAACATGAAGGCTGCACGGGTTTATCAAGTCAGAGATTGAAGAGTTATTTTGTGAGTTT

TGTGACTTGAGTGTTTTGTGAGCCACCTTGATGTTACCCTAACATCAAGTGTTGGACCTGAGTGTGTAGAGTTGATCT

CTATTGTTCAGAGAGCAATCTCTGGTGTGTCTTTGATTTGTTTGTAAACACGGGTGAGTGATTGAGAGGGAGTGAGA

GGGGTTCTCATATCTAAGAGTGGCTCTTAGGTAGAAGTTGCATGGGTAGTGGTTAGGTGAGAAGGTTGTATACAGTG

GCTGTTAGATCTTCGAACTAATACTATTTTAGTGGATTTCCTCCCTGGCTTGGTAGCCCCCAGATGTAGGTGACGTTG

CACCGAACTGGGTTAACAATTCTCTTGTGTTATTTACTTGTTTAATCTGTTCATACTGTCATATACAATCTGCATGTTC

TGAAGCGCGATGTCGTGACATCCTGTACGACATCTGTCCTCAGTATCAGAATTTCAATTGGTATCAGAGCAGGCACT

CTAAATCACTGAGTGAGATCTAGGGAGATAAATTCTGATGAACATGGAGAAAGAAGGAGGACCAGTGAACAGACCA

CCAATTCTGGATGGAACCAACTATGAATACTGGAAAGCAAGGATGGTGGCCTTCCTCAAATCACTGGATAGCAGAA

CCTGGAAAGCTGTCATCAAAGGCTGGGAACATCCCAAGATGCTGGACACAGAAGGAAAGCCCACTGATGAATTGAA

GCCAGAAGAAGACTGGACAAAAGAAGAAGACGAATTGGCACTTGGAAACTCCAAAGCCTTGAATGCCCTATTCAAT

GGAGTTGACAAGAATATCTTCAGATTGATCAACACATGCACAGTTGCCAAGGATGCATGGGAGATTCTGAAAACCA

CTCATGAAGGAACCTCCAAAGTGAAGATGTCCAGATTGCAACTATTGGCTACAAAATTCGAAAATCTGAAGATGAA

GGAGGAAGAATGCATTCATGACTTCCACATGAACATTCTTGAAATTGCCAATGCTTGCACTGCCTTGGGAGAAAGGA

TGACAGATGAAAAGCTGGTGAGAAAGATCCTCAGATCTTTGCCTAAGAGATTTGACATGAAAGTCACTGCAATAGA

GGAGGCCCAAGACATTTGCAACATGAGAGTAGATGAACTCATTGGTTCCCTTCAAACCTTTGAGCTAGGACTCTCGG

ATAGGACTGAAAAGAAGAGCAAGAACCTGGCGTTCGTGTCCAATGATGAAGGAGAAGAAGATGAGTATGACCTGGA

TACTGATGAAGGTCTGACTAACGCAGTTGTGCTCCTTGGAAAACAGTTCAACAAAGTGCTGAAAAGAATGGACAGG

AGGCAGAAACCACATGTCCGGAACATCCC3TTCGACATCAGGAAAGGTAGTGAATACCAGAAGAAGTCAGATGAAA

AGCCCAGTCACAGCAAAGGAATTCAATGCCATGGGTGTGAAGGCTATGGACACATCAAAGCTGAATGTCCCACCCA

-continued

TCTCAAGAAGCAGAGGAAAGGACTTTCTGTATGTTGGTCAGATGATACAGAGAGTGAACAAGAAAGTGATTCTGAT

AGAGATGTGAATGCACTCACTGGGAGATTTGAATCTGATGAAGATTCAAGTGATATTGATATTGAAATCACTTTTGA

TGAGCTTGCTATATCCTATAGAGAACTATGCATCAAAAGTGAGAAGATTCTTCAGCAAGAAGCTCAACTGAAGAAG

ATCATTGCAAATCTGGAGGCTGAGAAGGAGGCACATGAAGAGGAGATCTCTGAGCTTAAAGGAGAAATTGGTTTTC

TGAACTCTAAACTGGAAAACATGACAAAATCAATAAAGATGCTGAATAAAGGCTCAGATATGCTTGATGAGATGCT

ACAGCTTGGGAAGAATGTTGGAAACCAGAGAGGACTTGGATTTAATCATAAATCTGCTGGCAGAACAACCATGACA

GAATTTGTTCCTGCCAAAAACAGCACTGGAGCCACGATGTCACAACATCGGTCTCGACATCATGGAACGCAGCAGA

AAAAGAGCAAAAGAAAGAAGTGGAGGTGTCACTACTGTGGCAAGTATGGTCACATAAAGCCTTTTTGCTATCATCTA

CATGGCCATCCACATCATGGAACTCAAAGTAGCAGCAGCGGAAGGAAGATGATGTGGGTTCCAAAACACAAGATTG

TTAGTCTTGTTGTTCATACTTCACTTAGAGCATCAGCTAAGGAAGATTGGTACCTAGATAGCGGCTGTTCCAGACAC

ATGACAGGAGTTAAAGAATTCCTGGTGAACATTGAACCTTGCTCCACTAGCTATGTGACATTTGGAGATGGCTCTAA

AGGAAAGATCACTGGAATGGGAAAGCTAGTCCATGATGGACTTCCTAGTCTGAACAAAGTACTGCTGGTGAAGGGA

CTGACTGCAAACTTGATCAGCATCAGTCAGTTGTGTGATGAAGGATTCAATGTAAACTTCACAAAGTCAGAATGCTT

GGTGACAAATGAGAAGAGTGAAGTTCTAATGAAGGGCAGCAGATCAAAGGACAACTGTTACCTATGGACACCTCAA

GAAACCAGTTACTCCTCCACATGTCTATCCTCCAAAGAAGATGAAGTCAAAATATGGCATCAAAGATTTGGACATCT

GCACTTAAGAGGCATGAAGAAAATCATTGACAAAGGTGCTGTTAGAGGCATTCCCAATCTGAAAATAGAAGAAGGC

AGAATCTGTGGTGAATGTCAGATTGGAAAGCAAGTCAAGATGTCCCACCAGAAGCTTCAACATCAGACCACTTCCA

GGGTGCTGGAACTACTTCACATGGACTTGATGGGGCCTATGCAAGTTGAAAGCCTTGGAGGAAAGAGGTATGCCTAT

GTTGTTGTGGATGATTTCTCCAGATTTACCTGGGTCAACTTTATCAGAGAGAAATCAGACACCTTTGAAGTATTCAAA

GAGTTGAGTCTAAGACTTCAAAGAGAAAAAGACTGTGTCATCAAGAGAATTAGGAGTGACCATGGCAGAGAGTTTG

AAAAAACCAAGTTTACTGAATTCTGCACATCTGAAGGCATCACTCATGAGTTCTCTGCAGCCATCACACCACAACAA

AATGGCATAGTTGAAAGGAAAAACAGGACTTTGCAAGAAGCTGCTAGGGTCATGCTTCATGCCAAAGAACTTCCCT

ATAATCTCTGGGCTGAAGCCATGAACACAGCATGCTATATCCACAACAGAGTCACACTTAGAAGAGGGACTCCAAC

CACACTGTATGAAATCTGGAAAGGGAGGAAGCCAACTGTCAAGCACTTCCACATCTTTGGAAGTCCATGTTACATTT

TGGCAGATAGAGAGCAAAGGAGAAAGATGGATCCCAAGAGTGATGCAGGAATATTCTTGGGATACTCTACAAACAG

CAGAGCATATAGAGTATTCAATTCCAGAACCAGAACTGTGATGGAATCCATCAATGTGGTTGTTGATGATCTAACTC

CAGCAAGAAAGAAGGATGTCGAAGACGATGTCAGAACATCGGGAGACAATGTAGCAGATACAGCTAAAAGTGCAG

AAAATGCAGAAAATGCAGAAAACTCTGATTCTGCTACAGATGAACCAAACATCAATCAACCTGACAAGAGTCCCTC

CATTAGAATCCAGAAGATGCACCCCAAGGAGCTGATTATAGGAGATCCAAACAGAGGAGTCACTACAAGATCAAGG

GAGATTGAGATTGTCTCCAATTCATGCTTTGTCTCCAAAACTGAGCCAAAGAATGTGAAAGAGGCACTGACTGATGA

GTTCTGGATCAATGCTATGCAAGAAGAATTGGAGCAATTCAAAAGGAATGAAGTTTGGGAGCTAGTTCCTAGACCCG

AGGGAACTAATGTGATTGGCACCAAGTGGATCTTCAAGAACAAAACCAATGAAGAAGGTGTTATAACCAGAAACAA

GGCCAGACTTGTTACTCAAGGCTACACTCAGATTGAAGGTGTAGACTTTGATGAAACTTTCGCCCCTGTTGCTAGAC

TTGAGTCCATCAGATTGTTACTTGGTGTAGCTTGCATCCTCAAATTCAAGCTGTACCAGATGGATGTGAAGAGCGCG

TTTCTGAATGGATACCTGAATGAAGAAGTCTATGTGGAGCAGCCAAAGGGATTTGTAGATCCAACTCATCCAGATCA

TGTATACAGGCTCAAGAAGGCTCTCTATGGATTGAAGCAAGCTCCAAGAGCTTGGTATGAAAGGCTAACAGAGTTC

CTTACTCAGCAAGGGTATAGGAAGGGAGGAATTGACAAGACTCTCTTTGTCAAACAAGATGCTGAAAACTTGATGAT

AGCACAGATATATGTTGATGACATTGTGTTTGGAGGGATGTCGAATGAGATGCTTCGACATTTTGTCCAACAGATGC

AATCTGAATTTGAGATGAGTCTTGTTGGAGAGCTGACTTATTTTCTGGGACTCCAAGTGAAGCAGATGGAAGACTCC

ATATTCCTCTCACAAAGCAAGTATGCAAAGAACATTGTCAAGAAGTTTGGGATGGAAAATGCCAGCCATAAAAGAA

-continued

CACCTGCACCTACTCACTTGAAGCTGTCAAAGGATGAAGCTGGCACCAGTGTTGATCAAAGTCTGTACAGAAGCATG

ATTGGGAGCTTACTATATTTAACAGCAAGCAGACCTGACATCACCTTTGCAGTAGGTGTTTGTGCAAGATATCAAGC

CAATCCCAAGATAAGTCACTTGAATCAAGTAAAGAGAATTCTGAAATATGTAAATGGCACCAGTGACTATGGAATTA

TGTACTGTCATTGTTCAGATTCAATGCTGGTTGGATATTGTGATGCTGATTGGGCTGGAAGTGCAGATGACAGAAAA

AGCACTTCTGGTGGATGTTTCTATTTGGGAAACAATCTTATTTCATGGTTCAGCAAGAAGCAGAACTGTGTGTCCCTA

TCTACTGCAGAAGCAGAGTATATTGCAGCAGGAAGCAGCTGTTCACAACTAGTTTGGATGAAGCAGATGCTGAAGG

AGTACAATGTCGAACAAGATGTCATGACATTGTACTGTGACAACATGAGTGCTATTAATATTTCTAAAAATCCTGTT

CAACACAGCAGAACCAAGCACATTGACATTAGACATCACTATATTAGAGATCTTGTTGATGATAAAGTTATCACACT

GGAGCATGTTGCCACTGAGGAACAAGTAGCAGATATTTTCACAAAGGCATTGGATGCAAATCAGTTTGAAAAACTG

AGGGGCAAGCTGGGCATTTGTCTGCTAGAGGAGTTATAGCAGTTACTTCTATCTGAACGTGCTCAAACTTCTCACTT

AACATTAATAGCACGTTCACTACTGGGCCAAAACAAATTCAACCTCCGTTTCACACGTTCTCCTACATTCCTCATTCA

AACTTACATTTTCGTGGCAATCTCGTTTTCATCAGCATTCCCCAACACTTCTCAGATATTCACGAAACCACTCCCAAA

GCTCTGCTTCTCCATGGCTACCTCACCAAAAGAAACCTCATCCCCTGTTTCACCCTCTGTACCATCATCTCCATCATC

CTCCAAAACTCCATCAAACCAGGAACAACCTGCACTCAATATCCAATCCATACAAATGATTCCTGGTCCAGGCCCTG

TTCCTGAGAAACTGGTCCCTAAAAGACAACAGGGTAGTGAAGATTTCTGAAAACCCTAGCTTTGCAACAAGCCCTAG

GGAAGAAGACACTGAGATGGATAAGAAGATCCGCAGTTTTGTGAATAGCATTTTGAAAAATGCTTCTGTCCCTGATG

CTGATAAAGATGTCCCAACATCTTCCACCCCAAATGCTGAAGTCCTCTCTTCATCCAGTAAAGAGAAATCAACAGAG

GAAGAGGATCAAGCCACAGAGGAGACCCCTGCACCAAGGGCACCAGAACCTGCTCCAGGTGACTTCATTGACCTAG

AAGAAGTAGAATCTGATGAGGAACCCATTGCCAAAAAGTTGGCACCTGGCATTGCAGAAAGATTACAAAGCAGAAA

GGGAAAAACCCCCATTACTAGGTCTGGACGAATCAAAACTACTGCACAGAAGAAGAGCACACCAATCACTCCTACC

ACATCCAGATGGAGCAAAGTTGCAATCCCTTCCAAGAAGAGGAAAGAAATTTCCTCATCTGATTCTGATGATGATGT

CGAACTAGATGTTCCCGACATCAAGAGAGCCAAGAAATCAGGGAAAAAGGTGCCTGGAAATGTCCCTGATGCCCCA

TTGGACAACATTTCATTCCACTCCATTGGCAATGTTGAAAGGTGGAAATTTGTATATCAACGCAGACTTGCTTTAGA

AAGAGAACTGGGAAGAGATGCCTTTGGATTGCAAGGAGATCATGGACCTCATCAAGGCTGCTGGACTGCTGAAAACT

GTCACCAAGTTGGGAGATTGTTATGAAAGTCTAGTCAGGGAATTCATTGTCAACATTCCCTCTGACATAACAAACAG

AAAGAGTGATGAGTATCAGAAAGTGTTTGTCAGAGGAAAATGTATTAGATTCTCCCCTGCTGTAATCAACAAGTACC

TGGGCAGACCAACTGAAGGAGTGGTGGATATTGCTGTTTCTGAGCATCAAATTGCCAAGGAAATCACTGCCAAGCA

AGTCCAGCATTGGCCAAAGAAAGGGAAGCTGTCTGCAGGGAAGCTAAGTGTGAAGTATGCAATCCTACATAGGATT

GGCACTGCCAACTGGGTACCCACCAATCATACTTCCATTGTTGCCACAGGTTTGGGTAAATTTCTGTATGCTGTTGGA

ACCAAGTCCAAATTTAATTTTGGAAACTATATTTTTGATCAAACTATTAAGCATTCAGAATCTTTTGCTGTCAAATTA

CCCATTGCCTTCCCAACTGTATTGTGTGGCATTATGTTGAGTCAACATCCCAATATTTTAAACAACATTGACTCTGTG

AAGAAGAGAGAATCTCCTCTATCCCTGCATTACAAACTATTTGAGGGGACACATGTCCCAGACATTGTCTCGACATT

AGGGAAAGCTGCTGCTTCAGGTGCTGTGTCCAAGGATGATTTGATTGCTGAACTCAAGGACACATGCAAGGTGCTGG

AGGCAACCATCAAAGCCAACACAGAGAAGAAAATGGAGCTGGAACGCCTGGTCAAAAGACTCTCAGACAATGGCG

TTGATGATGGAGAAGCAGCTGAGGAAGAAGAAGATGCAGCAGAGGATACAGAATCAGATGATGATGATTCTGATGC

CACCCCATGACTAGCTATTGGGGCATGTCCCTTTGAACAATTGATTGTTATTGGTCTGTAATATTTGCACATTAATTT

CATGCCTTCTACTTTTGCCAAATTCTGTCTAAAAAGGGGGAGTAGTAGGATATTATGCATGATTTATGAAGGATATTA

TGCATGATTTATGATTTTGAGGGGGAGTAGTATTTATACTGCTGCTGCTGATGATGATTGATGTAAGCTACTGAAACT

AGTAGCTGATAGAAGATGCTGCAGTGAACTGCTGCCTAGCAGAATATTCACTTCACAGCAGTAAGAGCATGGAGAC

AGGGGGAGCAGAAAGCTGATGTCACGTGAGATGTCTTGACATCCTGGAAAAGACTTGTAGATTTGCAACTTGCAGA

-continued

ATTTTGCTGTCACCACTACAGATACTGCTGTGCTTGATTACTCTGATAATGAAAGTTGCTGATCCCACTTGCATGACT
GCTCGTACCTGCTCAGGAAGTGTCTAAGTATGTTTTAGACAAAATTTGCCAAAGGGGGAGATTGTTAGTGCTTAGCT
TTACTTAGTTTTAAAAGATTGGCTAAAATTTTGTTAAAACATAAAGCACTTAGACAATGAAGGAAAGCTGGAGTTGC
TGCACATGATGTCTAACATTATGTCAAGGAATCAGATTGGGGTGCACAATGCACAAGGCAAGATAAAATGTCAAAT
GAAGAATTGAAGCTGCAGGATCCACGATGTCGGATACAATGTCCAGGACATCCTGCCCGAAAATACTGGACACATA
AATCTGTTATATCTTTAACAGATTAATGTGCAGTCAGCAACAGATTAGGAGCTCTATCTTTAGGAACGAATTAAAAG
ATAATTAAAGATTGAATTACAAACTTGAATAGTTTCGTTCAGGGATTAGAGATTGAAGATAAAAACTAAAAGATAAA
ACTTTATCTTTTAGATCTTTAAGTGCAGATTTTTCAGGAGAATGATAGAGCTTATCCAGCGGAAGTTGTTGCAGCCCA
GATACGTACACTGCTATATAAACATGAAGGCTGCACGGGTTTTTTATCAAGTCAGAGATTGAAGAGTTATTTTGTGA
GTTTTGTGACTTGAGTGTTTTGTGAGCCACCTTGATGTTACCCTAACATCAAGTGTTGGACCTGAGTGTGTAGAGTTG
ATCTCTATTGTTCAGAGAGCAATCTCTGGTGTGTCTTTTGATTTGTTTGTAAACACGGGTGAGTGATTGAGAGGGAGTG
AGAGGGGTTCTCATATCTAAGAGTGGCTCTTAGGTAGAAGTTGCATGGGTAGTGGTTAGGTGAGAAGGTTGTATACA
GTGGCTGTTAGATCTTCGAACTAATACTATTTTAGTGGATTTCCTCCCTGGCTTGGTAGCCCCCAGATGTAGGTGACG
TTGCACCGAACTGGGTTAACAATTCTCTTGTGTTATTTACTTGTTTAATCTGTTCATACTGTCATATACAATCTGCATG
TTCTGAAGCGCGATGTCGTGACATCCTGTACGACATCTGTCCTCAGTATCAGAATTTCAGCTTTGACTAATTCAGAAT
AGACAGGTAATTTCAGAGACATGAATGGAATAAGATTGGAGTTTTCAAATGCTTGGAAGCATTCAAAATTCTCATTT
GAGAAGAACTCCATATCTATGAATTTTGGGTCTACAATGGAACGAGAGGAAAAGAGGTTTGTGTACCGTATACGCTG
TTCCTCTGATGAGAATAATGATCCAGAGGGAATGGAGGGAGGAATTGGTGCTTCTTGTGACCCGGAATGCAGCTGAC
TCCGACTCGAAGTTCCTTTTCTCTTTTTCGATGGTTCTGCCATTTGAAGAGTTTTTTTGGGATTTCAATCGGTTCAAAT
GAAAGAGATTGAAAAAAGATGAAGTTTGGGCTTTGTGGGGAGTGATTTGGATAAGAATTGAGTGAGATATGGCTGG
AAGAAAAATTGGGGGCGAGGGTTTTCGAGAGAATGAAAAGTTGCAGGTTTCAGAATTTGAAATTTGAATAAATAGG
TGCAGGGACGCATCGTAATCGATTACACACAATATGGTAATCGATTACCAGAGAGCAACTTTGCCAGAAATAACTG
CTTGTAATCGATTACACTATTATGGTAATCGATTACCAGTGGTTATTTTAGCCAGAAAACAAAAATAGAAGGCTTTCT
AGGAGAGAAGAAGTTTTGAAAACTATTTTTGAAAATACTATATTTGAAAATACTTTATGACTAATTTTCACTCATGTA
ATTTACATATCACGTCATGCAAAAATATTTAAAACATGAAGATAATCAATTTTATCAAGAACAATTACAACACAAGT
ATGAAGAATATTGATTTTACTTAAATAAATGAATGAATATTTCATGCAAATAGAATGAAATCAATCAAGCAAATATA
CTCATGATTTCAATCAATCAAAAGACAAACAAATAAAGAATTTTTAGTCATCATAGTCAATTTGTTTGAATAAAAAT
TTCAACTTTAAGAGAAATTTTAATAAGATAATGGTTTTGATATTACCTTTTTCAGAATTGAAGAGTCTAGATCTTCAA
AGATGAGGATCATGCTTTTTATCCTTGAGAGAAGTTCTTGTCACTTTCATAATCTTTAGTTAGAAGATTAATCTCCTTT
TCTGAACCATCAGATGAATCATTGTCATCCCATGCAATGTATGCTTTCTTACTTTCTTCTTTCGTCAAATCTTTTCTTTT
CACTTTTCTCCGACCATTCTTCATTTGACGGACAGTTGGCCTTGATGTGACCAATTTGGTTGCATTTGTAACACCTAA
GGACTTGAGAATCCTCTTGTGATTTTCTTCCATTATTGAAATTCTGACGCCTATCAATTCTTCTTTTCTTGATGTATTT
CTGAAATTTCTTAACAAAGAAGGAAAAATCTTCATCATCAGAATCTTCTTCTTCGTTTTCTTCTTGTATTGAAGATGA
GGCTTTAAGGGCTATGCTTCTCTTCTTTTTGTCATTTTCTTCATTCTGATTGAGGCGTTGAAGTTCCATCTCGTGTTCC
TGCAATTTACCAAATAAAGTGGCAAGAGACATGGAAGAGAGATCTTTGCTTTCAGAAATAGCAGTTACCTTGGGCTG
CCATTCCCTACTTAAACATCTTAAGACTTTATTAATTAAATCCTCATTAGGAAAAACTTTTCCTAATGATGCAAGATG
ATTTACAATATGTGTAAACCTTTTTTGTAAATTCTGAATGTTTTCATTTGGATTCATCCTAAATAACTCATATTCATGG
GTAAGAGTATTTATTCTAGAACTTTTTACATCTGTGGTTCCTTCATGGGTTAACTGGAGAGTATCCCACATATCCTTG
GCATTAGTACAATTTGACACTCTAAAGTACTCATCTATCCCTAGGGCTGAAGTGATGATATTTTTGGCTTTGAGATCG
TACTGGATTTTTCTCCTATCTTCTTCTGTCCACTGATCTCTAGGTTTTTGGGTTGAAGTACTTGTGCTTACATCTACTA

-continued

TAGTGGGTATATGTGGTCCTAATTCTATTGCTTCCCATATATTTAGATCTATGGCTTCAATGAATATTTGCATGCGGG

TTTTCCAATAATGGTAACCCTCACCATTGAAAATGGGTGGTCTGTGAATAGAATTTCCTTCAGGAAACAAGGGATTT

GAGGAGGCCATCCTACAAGAAACCTGCTCTGATACCACTTGTTGGATCGAGTGGCCTCAGAATAATTAAGAAGGGG

GGGGGGGTTGAATTAATTATTCCAAAAACTTTACCAATTAAAAATTACTCTTTTAAGGCTTTTACTTTTGTTGTTAAG

AGAATATGGAGTAGAAGAGAAACTTAACAGAAAGTAAAAGCGAAAATTAAATGCACAGTGGAAAGTAAAAGAGTA

TGGAAGAAGGAAACAAACACACAAGAGTTTTTATACTGGTTCGGCAACAACCCGTGCCTACCTCCAGTCCCCAAGC

GACCTGCGGTCCTTGAGATTTCTTTCAACCTTGTAAAAATCCTTTTACAAGCAAAGATCCACAAGGGATGTACCCTC

CCTTGTTCTCTTTGAAACCTTAGTGGATGTACCCTCCACTAGAACTGATCCACAAGAGATGTACCCTATCTTGTTCTC

AGTCAAACCCAAGTAGATGTACCCTCTACTTGTACCACAAAGGATGTACCCTCCAATGTGTTAAGACAAAGATCTCA

GGCTTTTAAACCTTTAATACTTTGTGAATGGGGATACAAAAGAATTCTCAGGCGGTTAAACCTTTGAACGCTTTTGTA

TTAGGGAATGGGAAGAATCAAAAGAATTCTCAGACTGTGTCGTTTTGAATTCTTTGACAAGGGAGAAGGGAGACAC

AAAAGAATTCAAGCGGTTAGTCCTTTGTTCTTTTGGAAAAGGGAGAAGAGAGACACAAAAAGAATTCAGGCGGTTA

GTCCTTGGCAAATGGCAAAGGGAGAAGAGAATGAAAAGGATGAATAGCACAAGTTTTCAAGGTTTAGAAAACCAGA

AAACTTCAGAAAGCTTTTGGTACAAAGAAGAAGAAGAAGTTCAAAGAGATTCAAAGAGATTCAAGGCTTGTAAAGG

ATTGTATGAATAATTGTTCAAGATTGTTGTTGGAAAGATTGATTCGGAATGCAAAACAAAGTCTTGCTTTTATAAACT

CTTGATGTCTGGTCAAGAAGGCCATTCAGAAGAGTTATAACTTTTTAGAAAAACTTAAAACCCATTTGAAAAAGTCA

AAACCTTTTTGAAGAGTTACATCTTTAGATTTTTAAAAAACAAACACTGGTAATCGATTACCAAATATGTGTAATCGA

TTACACAAAGCTTTTGAGTGAAACAATGTGACTCTTCACTTTTAAATTTGAATTTCAACGTTCAAGGACACTGGTAAT

CGATTACCAAAACATTGTAATCGATTACAGCCTTTTGAAAATATTTGGAACGTTGTAAATTCAGTTTGAAAACTTTTT

CAAACTCATTTTGCTACTGGTAATCGATTACAACAATATGGTAATCGATTACCAGAGAGTAAAAACTCTTTGGTAAA

GGTTTTGTCAAAAACTCATGTGTTGTTCAAAGTTTTGAAAAACTTTTTAATACTTATCTTGATTGAGTCCTTTCTTTAT

TCTTGAATCTTGAGTCTTGAATCTTGAGTCTTGAATCTTGATCTTGATTCTTGAGATCTTGAATCTTGATTCTTGATTG

TAGGCTTTCTTCTTGAGTCTTGAATTCTTCTTGATTCTTGAACTCTTGACTTGTTCTTGATTCACTTGAGATGTTCTTTG

ATTCACTTGAGTTTTTCTTTGATCTTTTGAACTTTTTGTTCATCACCATTGTCATCATCTTTTGTTGTCATCATTGTTAT

CATCAAAACACCTTTGAATCATTGTTGATTCATCATGAAGCTTTGCTTCCACAGATGGTGGTTTAGGCTTGAAAAAA

AAGCTTTGTCAAAAGTGTTGGTGTACAACAATCTATGCACAAGGATCTCGTTAAACTCATCTGGGAGATAAGAAATT

TGTTTTTTCATGAAAATTTTCAAATATGTTAACAATTGTTGATGGTTGATTTTAAAGATTAAGATTTTTCACGAAATTC

TTTAGATCTGTTCTATTACTTGATTCAATTGAAAATTGTTTAATTGTATCGTATTATTTTATTATATGATTTTTGTTGTT

GTATTTGTTGTCTTTGGATATGTAAATACATCTTCATTATATTTCTCACCGGAAAGAGATAAAGATAGAAAGGCTAAA

AAGAAAAAACAAATAACAAAAAAATCTTGATTGTTAGATTAAAAATAAAATAATCTATTTTTAAAAAAAAGGAAGC

GATCTTGGACGGTTGAGATAAGAGAAACTTGCAAACACATTGAGTAATAGATATATCCAAAGGCCAAAAAATAGTT

ACACATGTTGCAGGACCTATCGGACTTTACCACACTAGAAGGCGTCATAACCTATATCAAAGTGTCGCAACCTACCC

TTCGACGGGACGGCGAGGCGAAAAGCCAAAGTTGCGTCTTCTCATGAAGAAAGCGCGTAGAGTCGCCACCAACGTT

TATTCAAGGAAAACATTAGAAAAAACCAAAAAGAGGTCTGCGGATTTTGAAAATAAGGGTTCGGGAGTTGTTTACA

CACGGGGAAGGTATTAGCACCCCACACGCCCGTCACAAGAGACGACAGCCTTTAATCGAATGTGCAAAAATGTGAC

TTCAAAATTATGTGAGGACTTTGAGTCCTATGAAAGATAAAAGTGAGGACTTTGAGTCTTGTGAAAGATAAAAGCGA

GGAATTTCAATCCTGGGAAAAATAAAGGCAAGGACTTTGAGTCCTCTAAAAGATAAAGGCGAGGATCTTAAGTCCT

CTAAAAGATAAAGGTGAGGACTTTGAATCCTCTAAAACAAGCCAATAAGCACTAGTACCAATGGGCTCAACCTTAA

GAGAAAGCAAGAGATCGACTTTTTGAGAGGGCCTCTCATCCTTAACTTAAAAAATTAGATTTGGTAAAGTGGTATAT

AAAGAGAAATCTACGCACTTATAGCCTAATATGAACATGATTTTGGGATGCAGATGCATGCAACCTTCATCTTGAAA

-continued

TGCTAATAATGCAAAAGGTTTTGAATCATGAAAATTGTGTAATGCTCATGACATTCTTTCCTATTTTTGTGATTTTGAT

TTTGATTTGATTTTTTTTTTTGTGGAAAACACATATTGACTGTCTCTTTCTAGAAGACATGATAATTCATGCAACCTTA

TTTTTTTTTTTTTTGCAAATCTCTTCGATGACTCCCTTAGAGTGTATGTTTTTGTTTGATCACTTGAAAATTTTGGAGTG

ACGGCAATGGAGCTGTTTTACATTTAATCAATCAACCGAAACATTGATCCTAGGGTTTGTCCCTTTCTTTTTTGTTTA

AAACCTTCTATTGTTCTGCACAGCAAGAAAACATAAGGCTTTGGGATCGATTGTGCACCACACTGAAGGATGGCAAT

GAATTGTCACACTTTGGTATGTGACCAAGTGAAACTTTCCTGATTTAAGGTCATAGAGTGATGCCAAGGGTTTGTCG

ATTCCACTGAAACTTGATGAAATGGGCTAATCCCGAAAGAATTTATACCACAAAGGCCACCCTGGATTCAAAAGGA

ATTCTAAGGAGTCTGCATGAGCAACTAATATCAGATGTACCCTACTATCACAATTGTCTTTGGGAATTTTCCATGAGC

TCCTGGTCGAATGAGTTTTCTTCTCAGATGTACCCTACTATCACAATTGTCTTTGGGAATTTTCCATGAGCTCCTGGT

CGAATGAGTTTTCTTCTCAAATGTGCAAGTACAAAACCTCGAGGATTCTTTTTGTTTTGTTTATATATATATTTTTTTA

ACAATCACAAGCGTGTGTAGGTTTCATTCTAGAATCCCAACTTAAAAGAAAAATTAGTCATTCCTTGATCCACATGG

GCTTTACTGGGCTTGTAACGTGGTCAGGGGTAAGAAGACTATGAAAGAAAGGATTTAGAGAGGCTTAAAGAGTGTTT

AAGGGTTACATTGAGTAAGAACCTCAAGAGCATTGCTTATACCTTTTGGGTTGAGCTCTACTCCTTTTGTCTTATACA

GTAATCTTTATTGCACTTTTGTGCCTTTCTTGTAAGATTTGGAGATCTTTTGTCTCTTTTTTTTTCTTCACTCGCCTTTG

GCGGACTTTATCTCTCTTTTTTTATTATTGTTTCCCAACTTCATGCATGTGTTGTTTGCATTGCTCTTCCCACCAGTTTA

GCAGTGGTTCCTACTCAGAGTTCCTATTTTGTTTTTGTTGTTTTTCGAAAACAAATATGCTTTGGTTCGGAGAGGGTA

GCAAGGGATAAATTAGTGTTTGGGATGTTGAAACATGGCCATGTGTCATTTCAAATCTTGACTAGATACTTTTGTAGT

TTGGATTTTGAGACAAAACCTTAATAACACGCCCCTAATTGTTTGTTTTTTTTCTTTTTTATTATTACCCTAACTTTTG

CCTAGGTCACCCTTTCAGGTTCTGAACCTATCGGGTAAGAACTTCTGATCTGCCCCTAAGTTTGCTTGAGGCTCATGC

ATGGTGCCTCTCATTGCCCCAATGTAGGGCTCTGAGGTATCTATTGTTGCCTTTTGTCATGACCTTGTAGCAAGGAAA

AAAAGAAAGAAACTATGCAGGTTCTCAAAAATGAATTCCGAAGGATGAGAAATGTTTAAAGGATTTTCAATTGACA

GATTAAGTCGAACGACTCTTGTTCTTGATAATTCACTTTTCTCTCAAAAAGAAAACTTTTAAGAATGATAAAATAAGG

TCACATGAATGTTTTTACTTCTTATTTTTATTTGAAACACGATTAATCAAACGTTTTTTTTTTACTTTACTCGTCGTTT

ACGGCACCCTCACCAAACGTGTAGAACGAGCAATTTCTGATTGAACAGACTTGGAGATCAACTCAGAAGTGCAGGT

TGCTTGAGCCAACAAACCAATGGCTTACATTCACATTCCAGTGAAAGTAAAATAAGCAAAGACGTAATTGCGAGAG

AATGAGAGACAAGGACATCAAATTTATCCATATTATTAGCATTGTGACTATTGTTTATAATAATGCCATAAACTTAA

AAATCCTAATGAGTCATTGGAGACATCTAACAACAACCTTCAAATTGCCCCATGCATAGTGTAGCTTGACAACGTTA

GAATTCGTAAGCGATTGTCCTCCTCGAATTTCAATTAGACTTTGCACCTTACGTTTCAGGGTCATACAATGCTCAATG

GAATTCCCAGGAACTCCTCCATGATAAGCACATTTTGCATTCAAGTTGTATCCTCGGGAAAATGGAGGTTGAGGAAT

CTTTGTTGGGATTATGACTACCATTGCATTATTAAGTAGATATGGGAGCAAATTAGCATACGACACGGGAATTGGGG

TGAATTCTACAGGCTTCTTTTCTAGAAAATTCCTTCCTTGGTTAGTGTTTTGGTTTGTGTTAAGGGTGGTGTTTGATAT

CGGATGTGCGACAGGAGGGCTTTGCGGCTGATTTAGGGGTGGCCTTTGTGGATGATTGGGTGTTCTTGACTGGTAGG

GTGGTGGGCAATGAGAAGGACTGATATTGGCTGAGTGTTGACATTGTTAAGTTGGCGAGAAATTTGGCCATGTAGGG

ACAACAGTCATAGCACGGGTTCTTCCCTCCTTCTTATTCTCTCCATTTTCCCCAAGCTTCATATTCATCCAAGTAGGA

TAATTAAATTTTCCTCTTCTTAGATCCACTTTGATCCTTTCGCTGGCGAAAACCAAATCAACAAAGCTTGAAGGCATG

TAACCCACCATCTTCTCATAGTAGAACATCGGTAACATGTCTACTATCATTGTTATCATCTTCCTCTCCATCATTGGG

GGCGCTACTTGAGTTGCCATATCCCTCCACCTTTGGGCGTATTCTTTGAAAGATTCATGCTCCTTCTTGCACATGTTC

TGTAGCTGCATTCTATCCGGAGCCATATCAGAATTGTATTGATACTGCCTAATGAAGGCAACCATTAGGTCCTTCCA

AGAATGGACTCGGGAAGGTTCCAAATTGGTATACTAGGTGACGACTATCTCAGTAAGACTTTCCTGAAAGAAATGCA

TCAATAATTTTTCATCTTTCGCGTATGCCCCCCATTTTCCTGCAATATATCTTCAAGTGATTCTTGGGGCAAGTAGTC

-continued

CCCTTGTACTTATCGAAATCTGACACCTTGAACTTCGGAGGGATGACGACGTTAGGCACTAGGTACAACTCTGCCAT

GTTAGCAAAAGCATGATCTCCGCCTCCTTCAATAGCCCTCAGTCTTTCCTCTCTCTGATTGAATTTTTCCCTTTCCAC

CATAGCAGGAGGGACTCTTCCCACCGCAAAATGCAAGGGTTGTGGTTGTGGGAAAAACTAAGGGCCCCCAAAGTGT

TTGGCAGGGGTACACCACTAACTGCTGCCCTTCAGTGGCATATCGGAGGTGAGGTTCGAAGTCGATTATATTATGG

TCTCGGGGTGCTTCATGTGTCTCCTCCATGGGTTGAGAGACATGTGCATGATCAGATTGGGGTTTTTGGCTCTCAATG

GGTATGGGGGCATGAAGTTGTCGACATTCTCATCGTGAGTGTGTGCAACATTGGGTGGTGCGTAGTTGGGAGGCAAG

CCAGGGAATGAATGCTGCTCTAAACTTGCACAAAATGGTGACTGGAGGATTTACTTGATTGAGGCTCGATAAGTAA

GTCAGGTCTACCTCAGTGGTGACACTCGTAGTGGCAACTGCAACCGCATTGCTTTCCATTATTTTCTTCATGCTCAAC

ATGGCCTCCATCATGGCGGCCATTTGGTCTTTCATGGCCTCCATGTCGGCCTTCATCTGTTCTTGCACTTCTTCTATTT

CACTCATTATTCTAGCTCAGGCACGCGTTCGGTAAGGGCGCCATAAAAGTGCATTCTTTCCTTTTGATTACAATGATT

ACAGTTTTGATTTCAAGGAAATAATGAAATGAGCAATGCAACCAACGTGAAAAGAAAAAATAAGCATGGATGTATG

TGAACAAATACATTGTTGAAGTATTGCAAATTTACATAGGGCACTCAATAGGGTCGAACCAATTTAGATTTTCATTA

AAACAACATTGTTCATTACATTTTGTCAAAATGCAATAGGAAATAACGCATGGACATCAACAATCCCTAATTTTTGT

TAATTATTTAGCTCAACCATGTGTTGGCAGTAGACAAAGAAGCTATGTAAACTTGATCCATCTTCTGCCCCAACTTTT

GCAAGCTAGTTATTTCCATACTTGACTTTGACTTGATGAAACCTTTTTCTTAAAAGCATGTGCTTGGTTCGACCCCAT

AATCCAAGGAATAGAAATTTTGACTGTCAATACTTCAACAACATATCATAGAGATGAATGACTTGGGCATACTTATG

CTATGCATGACACATGTAATTATGAGGTTGACATGAGATGCTTGAAGAAACATCATTTCCAAGTTAACCATGCATTA

GGTACCATGTTCACATGATTTTCAATAATTTTTTAAGAGAAATGAGTGCATAATCCCAACATGGTTGGTTTATAGCTA

TCATCATAGTACCCAACACATGTAACTAAGAATGTGGTGTAAACTTTCACACTTTATGGTGACTTTCTTTTGTTCTTT

CTTTCTTTATTTTTAATTTTTTTTTTTTTGCAGAGGAAAATGCAAGGATCATGCATGCAAACTATGAAAATAGAATGT

ATGCAGTTGGCAGAACAAAAGCATGCTAAATGAAAATGCATGACAATGCAACAACTTATGCAAATGCAATGCATGG

ATATGACAAATGATAAATGCAAGAATGATATGTACATTATGATGCCATGAAGAGATGCATGATGCGATCAAAGAAC

AAGCCAGAGTGAGTTTTCTATGTGCCACCCTAATTTAGGAACCTAATGGAAAGGATCCAAAAGTCCCCTTCTAGTCA

CAACTTCCAAGGATGGTTTCATGTAACTTTACCGGTCTCTAGAGATATCATCCTGTTAGATAATACATTGTGGCGATA

GGGACTATCAGCGACAATGCATCACCAAAAGAGGAAAACTCTAGATAAGGCTTCACTGTTACCAAGCGAGTCAGAG

ACCCAGCATGAACACAGATTGACCTCCACTCCTTATGGCTCACATAGACCCGGGTATAGGGCCTAATATCTCAACGT

GTGTGCGAGGCGTAGGTGCCATGTGTGCGTAGAAAAAAATATTTCTAACTATGAATGTAATTGATAGACAAACACAC

ACCAAACACAACAACATAGCAAAGATTATATACAAATATGGACAAAACAAAAGATAAAAGGGAAAAGGGAACATA

AATAAAGAAGAAGTCACGATAAAAACATTGCACACTGGCTGAATGACCTAACTCTCTAACAGTCCCCAGTGGAATT

GCCAACTGTCACAACCAACCCTTTGGCGAAAGGGCGAGGCGAAAAGCCAAAGGTGCGTCTTCTCATGAAGAAAACA

CGTGAAGTCGCCACCAACATTTATTCGAGGAAAACGTTAGAAAAAACCAAAAAGAGGTATACGGATTTTGAAAATA

TGGGTTCGGGAGTTGTTTACGCACGAGGAAGGTATTAGCACCCCACGCATCCGTCACAAGGGACGGCAGCCTTTAAT

CGAATGTGCAAAAATGTGACTTCAAAATTATGTATTTTCCCTTTTTATATTTTTTATTTTTTGGGGTCGACAAGGGTGT

TGCCCTTGCTTCTACGTATCCTCAGGTGCGATGAGGAATTTAAACCTACATAGTTCTTTAAGTCTGAAAGTTTGTGTG

TTACATTAATTTTATGCTTTTTAAAAGATCGATTTTAATTGCGAACAAAAGTCGTTTAAGGCATTGGACCTTGAAACG

ATGTTTTAAAAATTTGAAAAGCGGAGAGAATGGTTAAGGCGTTGGACCTTGAAACGACCTCAAGTGATGTTTGATGA

AAAGCAGAGAGAATCGTTAAGGCATTGGACCTTGAAACGATCTCAAGCGATATTTGATTAAATGAAGAAGTTTATGA

GTTGGTTTTATTTTGGTTTTGCTTATTAACCTTCAATCTTTTTTAAAGATAACTTGTAAGGGTGCACAAAACAAGAAA

GAGGATGAAGATGAGATTATTGATGATAAAAGAAGGAGATGAAGATGCACAAAACAAGAAAGAGGACTCGTAAGG

GTGCGTAGATCGCATTCAAATCCTTAAAACAAAAACTAACCGGATGACAAACGAATAACAAACGAAGAACAATGTA

-continued

GAAGTCGATTAGGATCGCAATTCGGTAGCACCTCGGCCTCGTTTTTCTCTTCTTTCTTCTTCTTCTCTCTGATTTCTCT

CAATGTTGGACCTTGGAACCCTTTACTCAGCCTCCCTCACACCTATTTATAGCAAAAGATGGCATTAGGAGTCATGG

CAGCTCACCCAGGCGAGTTATAGCTTCAACCTGAAGTAACTTTGCTTGCCCAGGCGAGCTAGTTATTTCACCCCTAA

GCTATTTTGGGGCCTAAGCGAGCCAGGGGCTAGCCTGGGTTCAGAAAAAGGCTTAAAATGACCCTGTTGCCCTCTTT

TTTTGGGTATTTTCTGTATTCCTTATGGAAACATCAAATGATCTTTCATCTTGCACGGTAACTGGTGTCATACAGCTTA

ATTCGGCTAGCGAGGATCAAAAGATCAACAAATGATAGTCTTAGAACGAAATTAGGGTATGACACAAAGTTATTAA

ACTAACACTCGTAGTCTTTATTGTCTAAGCCTTTCTACGCCCCAGGAATCTGGTGGGACTAAAGCGCTTAAGATTAA

CAATGTTGGAATGTCCATCAATAACAAGCTCAGCAACAACTCCAGTGGCAGGACCATTAAGAATATTATCCCAATTA

TGCCCTGTTGCAACATAACACCCCTTCACCCCTGGAACCTCTCCTATTACTCTCCCTTCACACATGCCACTCCTTCCC

TAAGATGGCTTGAAACAGTCTTCACCACCTTTTTAAGCATCACAATTAATTCAGGGTTTCCCTTTATCTCCTCACGAT

TATCCGAAACTTCTTTCTCCTTCGACATCCCACATATATAAACCTCCCCTGAAAATAAATGTTTACATTATTAACCTC

TTTATTAATATTATTATTACTAAGTGTGACTAATTACTACACCTGGGAATCAACAAGTTGCGTTTGTCCGAATGATAC

TAGATTCTGTTTGGAAGGGAAGAACTCATTAAAAGTGACCAGTTAAATTCTCTAATAAAAATTAATGATTGGTAAAG

TCGGTAGATGTTCTGTAAAAAAATAAAATTAACATACCTGTGTGGGGAGGGTACACTTCGGGGTCAAGAGATTTTCC

TCGTTTAGAAGAATAGTAACTGAGAAAGAGGGCATGCAGGGTTATAGAACCGGGCTCTCTGGCCTCTAATACAATG

CTATGGGCCTTAAGCCCATAAGCCCATAAACTATGAACAACAAAACCAACTTACTGGACTAAGGGCCCAATGTTAA

CACCATAGAATCCGCTTCCAAAACTCGTCCTTCTTCAAGCACCATCGATCCAACTCATCCTTTCTTCCACTTCCAACCG

TTCCTATTTTGTAATCTCTATCTTCACTCCATGCTTCTCCACTGATCTATCAATCAGCGCGGGAATGAAGAGCCATAG

GTGCACCTGCACTGTCATTTCGATGGTTCCAACCACGAGTAGGTCTGTCAACTCAAGACGACAACATTGAGGTGGCA

GAAAAGGAGCCTTCAAATTCCGTAACGATGAGGCTGAGAGTGGTGAGGGTTCTGTAACTGTACGATCATGAACCGT

CTAGTTCTTCGAAGAGTGAACGGTGGAGGTTGAAGCTCATGTGAGCTAGCTCTTCTAGCGGTCCTCTATTGCACCAA

TTGAGGGCAAGGAATCTGCCAGCTTTTTCGAATGCAGTGCATGCCACGTTGAATTTCTCAATGAGCATGATATAGAC

ACCCTTCACCGCCAGAAAGTAGGCGGTGCAGACTTCGATGACTCCATCGCCGCAAACAACCACTTGCTTCGAATGA

TCCATGGACAGTGAATCAATCAACTTTGCTGTCAAGATGTGAATTCTGTTTTGCCAAAATGCAATTAGTGGTGGCCA

CACCCCACCACTTGATTCATTATTCATACTCATCCAAAATCTTTTTTCTTTTATTTTTTATTTTTAATCAAGCACATGT

TTGTTAGTATGTTGTTCACGTTCCGACATTGGCAAAAACTTCTACTATTTGATGGACTATTTGGGCCCTTCTGATAA

AAGAAGTGCATATCCAATATTAGCGAACTACTATAGGCACCACCTACTTTTTCTAATGGCACTAACCGTGAGGGTGC

TTTTTGTCCATATTTCAAAACTGTCCCCTTAAAAATTACATAATAGAAACGTGCTTCCATTGTGCAATTGGGGTGAAA

AAAATGTACAACAAAAGTACACTTTCTTTGTGTATTTTTCCCCCTAATTGCATAACAAAAACATGTTTTCGTTGCACA

TGGATAGTTACACAATGGAAATGTGTTTCTTGTCTAGACATACAACAAAAATGTGTTTTTGTTTTGTTAGAAAGCA

TAAAAAATTACACAATGAAAACATGTTTCATTTGCACATGGGTAGTGTCGCAACCTACCCTTCGGCGGGAGGGCGAC

GCGGGGCTCACAGGTGCGTTTTTCAAGAAAGGAAAATGCACGGAGTTGCCACCAACATTTATTTGAGGAAAACATC

GGAAAAACCGAAAAAGGTGTGGTCTACGAACTTTAATCGTGAAAGGTTCGAGAGTTGTTTTTATGCACGGGGAAGGT

ATTAGCACCCCACGCGTCCGTCACAAGGGACGACAACCTTTAACCAAGTGTGCAATATCATGTCTTCGATTTGTTTT

ATTTTCCCTTTTTATGTTTTTATGTCTTTTTTATGCTTTTTGTATTTTTTTTATCTTTTTGTGGTCGACAAGGGTGTTTCC

CTCGCTCCTACGTATCCTCAATTGCGATGAGGAAATCAGACCTACGTAGTTCTTTAGAACTAAACGTTGGTTAAGTT

GTTTTTATCTTTTTTCGCAAGATATATTTTAACCGAACAAAAGGTCATTTAAGGCGTTGGACCATTAAACGATCTTTT

GATTTTGAAAGGAGAGAAACGTTAAGGCATTGGACCATTAACGATCTCTTGGTTTTTGAAAGGAGAGAAACGTTAAG

GCGTTGAACCATTAACGATCTCTTGGTTTTGAAAGGAGAGAAACGTTAAGACGTTGGACCATTAACGATCTCTTGGG

GTGGTCAACAAAAGCGGGGCTTTTGCTCCTACGTATCCTCAATTGCGATGAGGAAATCAGACCTACGTAGTTCTTGC

-continued

AAAAGCGGTAAAGTTATGTGTTGATTTTATGCTTTAGAACGGTCCATGTTAACCGATAAAAGCAAAGATGATCGTTT

AAGGCGTTGGACCTTAAAACGGTTTTGAGTGACTTTTGCGGACGAAGCTTGATTTGTGAGTTGATTTTAGCCTTAATT

TCACTTTGATTATTAGTCAATTCATTCAAGGAAACTTCCAAAGAAAAACATCCGATTGATTTTTTTGATTATTTTATTC

AAAGATATTTTGATTATTTTATTATTATTTTTCCCTTTTTTTGTCTAACCGTGGTTACAGTGTGAACGATTGATTAGAT

TTTACTTTAATGGTGATTAATCGAGATTACAACTCAAATGATCGGTTGAAATTTATTTTATCATTTACTATGTGAGAA

AACGGATTAAATAAACGGTTAAAGCACGATAAAAGGGGGTACGGAAAACAAACGAAATGAAAATAAAAGTACGCG

AAACAAGTAGGGACCACTAAGGGTGCATAGAATGAATTGAGAGATTCAATTTCGGGAACTTATCGAATGAAGACCG

AAGAACGATGAAGAACGAACGAAGAACGATGAAGAACGGTGAAGAATCTCCACGAAATCGCCTACGGAAACGTCT

CGGAAGTGTTACGGAAGCACCTCGGCTTGGATTTTTTTCATGGAACAATTTTTCTCACTAATTTCGAGAGAATTCTCA

AATACTAGAAGGGCTGAACCTTTTGTTTTGCCCTCTTTCCCCAATTTATAGGAGAAAAAAGGGAGGTGGTTGCCGCC

CAGCTCACCCAGGCGAGCAGGGTTGTTTCCACTAGAAGGCACCACCTTCTTTTGGAACTCTCAGGAAGGCCCAAGTG

GGCATGGTTGCTATTTGCACCCCCTTTTTCACTAAACACACTCCCTTTTGTGTTTTTTTATTGATTCCTTTCCGAAACG

TTACGGAACTTTACGGATTACGTAACAACACCCATTTTCATTTTGGAATGTTGCGAAACCTTACGGATTACGCAATG

ATGCTTGTTTTTTTCCTTCCGGAATGTTGCGGAACTTTACGGATTGCACAGCAATACTTCTTTTTGACTTCCAGAATGTT

GCAAAACTTTACGGATTGTGCAACAATACTTGTTTTGACTTCCAAAATGTTGCGAGACTTTACGGATTACACAACGA

TGGGTGTTAAACATTTTGAGGCGGTCAAGAGAAGGTCGCATGCCAACAAATAATGGTCCCTGGACGAAATTAGGGT

ATGACAGTTGCCCCTCTTTACTTATCTTTTATTGGAGATAAAAGCGAAGTAAAGATAAGACACTAATTTCGTTCGAG

CAGAACATCATTCGGCCGATCAATATCCCAACCAGCGGAACCTGTCATTTAGAAAGAAAAGAAAAGGCACCAGAAG

CGTTAGCAAAACTTCAGTGTCTTGAAAGCGATAAAACAGGATAACCATGACGTTTCCACATGCTATCGAACTCGATC

GTCCCTGCCTAGCAGTGAAGAATCTTGCGCGTCGTCGGACTTGAATGTCTCTGGATGACGAAAGTAAAACCTGCAAA

AATTTTCAAAAATAATCAGAACCGGACGACCACATCATCCCGATACCATCGAACTCGTTCACCTTGGTTGACGAAAG

GTGCGGATAACCATAAGGTACCCCCGCATGTCATCGGATTCGCCGTCTTTGGATGACAAAAGTAAAAACCTGCAAA

AATTTCAAAAAATAATCAGAATCGGACAACCAACATCATCCCGATACCATCGAACTCGTTCGCCTTGGTGGACGAA

AGGTGCGGATAACCATAAGGTACCCCCGCATGTCATCGGACTCGCTGTCTCTGGATGACAAAAAGTGCAGAAGACG

ATGTTAGTCTATGCGTGTCAACGGGCTCGCTTGCCTCTGGTTGACAAAAGGTACAGAAGACGACGTTAGTCTCTGCG

TGTCAACGGGCTCGCTTGCCCCTGGTTGACGAAAGGTACGGAACACAACGTTAGTCTCTGTGCGTCAACGGACTCGT

TTGCCCCTGGTTGACAAAAGGTGCGGATAACCATACGGTACCTCCGCATGTCATCGGACTCGCCATCAATGGATGAC

AAAAGGTGTGGATAACCATACAGTACCCCCGCATGTTATCGGACTCGCTGTCTCTGGATGACAAAAGGTGCGGATA

ACCATACGGTACCCCCGCATGTCATCGGACTCACCATCTCTGGATGATAAAAGGTGCAGAAGACGACGTTAGTCTCT

GCGCATCAACGGGCTCGCCTCCCCCCTGGCTGACGAAAGGTGCAAAAGACGACGTTAGTCTCTGCGCGTCAATGGG

CTCGTTTGCCCCTGGTTGACGAAAGGTGTAGATAACCATACGGTACCCCTGCGTGTCATCGGACTTGCCGTCTGTGG

ATGACAAAAGGTGCGGATAACCATACGGTACCCCCGCATGTCATCAGACTAGCCGTCTCTGGATGAAAAAAGGTGC

GGATAACCATACGATACCCTCGCATGTCATTGGACTCGCTATCTCTGGTTGACAAAAGGTGCAGAAGACGACGTTAG

TCTCTGCGCGTCAACGGGCTCGTTTGCCCCTGGTTGACGACAGGTGCTGATAACCATACGGATAATCGCTTGGGTAT

CTCCACATGTCACCGGACTCGCCGTCTCTGGATGACAAAAGGTGCAGAAGATGACGTTAGTCTCTGCGCGTCAACA

GACTCATTCGCCCCTGGTTGACGAAAGGTGCGGATAACCATACAGTACCCCCGCCTGCCACCTGACTTCCCGGGTCA

GGGTTAACAGAAATCGTTTGTACGAATAACCGCTTGGGTATCTTCGCATGTCACCAGACTCGCCGTCTCTCGATGAC

AAAAGGTGCAGAAGACGACGTTAGTCTCTACGTGTCAACGGGCTCGGTTGCCCCTGGTTGACAAAAGGTGCAGAAG

AAGATGTTAGTCTCTGCATGCTACCGGACTCTGAGTCTGACGGATAGCAAATGAATGTGTGCGGGTTACCGTATAGG

GCATCTCCGCGCACCAACGGACTCACAGGTCACGATAGCAAAAGGTTGGGCGGTCGACAAAAGCGAGGCTTTTGCT

-continued

CCTACGTATCCTCAATCACGATGAGGAATTCAGACCAACATAGTTCTTGCTTTTGTGATACTAAAATAGTCTCGGTGT

TTTTTCACTAAAATGCAAACAGGCTTTAGTAAAGAAACAAAACCTCCAACTGATCAGAGCAACATATGATTTTTGAT

GAAAAACAATGTGTCTAATGGGGAAGGAGAGTATGCTAATGAAATTTTCTCATAACCATAAATGAGATTTTGGATGT

TAGCATTTTGTTTCTAAACGACCATTTAGAGGAAACACTGGGTCCAACAAAAATAGAAGAAAATCACTCAAAGTGTA

TCAATCTCACACAGGTAAGTGTTTCATCCTAATTCAGAACCATAGATATGTCATGACTTGATTTTGCAAATCATTTCC

TATCAAATCAAAGATTTACATGTGTGATCACAGATCAATAGGACTTTTTCGGGAATGGTGTTTTTTTTTTTGTGGGAAA

TTTGGCTCTGAGTGTTTTGGCCTTTTCCTTTTCTGTTTTTGTTTAGTGCGGGGCGAAAAAGTCACCGACGCACAGGAT

TTTGGTTGGCAATCAAACGGAGAGGACCACTTCAAGTCGTGGTTTCCTTTCTTTCCTTATTTGGCTGTGACTATTCCG

TATTGTTTGGATATTTGTCTTGTCCGAAGACACTTCTGTATAATTCTTTCATTGTCTTTGATCGGAGATTTTCTCCTTTT

TTTTTCTCTTTGTTTTCTCACAATCTTTGATCAGGAATTTCTTTTTTTCTTTTCTTTTTCTTTCGATCTTTGATCGGGAACT

TTCTTTGTTATGGAAGCATGTTAGCAACTCAATAGTGAATGACTTTTTTTCTTGGGAGACCCTATTGCTCCTTCTTCTG

AGGACAGGGATGGAAATTCTCATCCTGGGTCAAGGTTTATGGTGGTTTGAGGTCTTGGGTCAAAAGGCTTGTAGAAC

GGCCGGACATGATGTATGTCAGGGTGTTGGTTTGGCCAGCGGTTCAGGGATAAAGGAATGTCTCACATTATTTCCAT

GACACACATGCAACAATGATGATTTAGAAATTTTATGCAAAACTGGTCATATATGCACCCATGTGGACACTCAAGTA

TCAAGTTTTTATGGTCATGTGACACTAGGGCCCAGGATTCATTTTCCCTATTTAAGTCAACCTAGTGTTTCCAAAACA

TGTTTTTTTTATCAATTCATGCATCCATTCGAGTCCATTTTGGGCGTTCAGAAAAATTTCACAGCATTCACCCTTCAG

GTGTAGACACATTTTCCTCAAAAACCCTTGTGTTTTGATTGGTGACTCTTTCCAAAGAAAAGCTGGAGACTATTTCTT

TTCAAAAGCATGTTGGCTTTTTAGTTAACCAATTATTATTATTATTTTGTTTTTTTGTTTTTGTTTGTTTTTTCATGAGG

TATTTTGCTACCTAAACATATGTATATTTTTGTGAGGTATTTTTGCTATATACATATGTATCCAAGGTATCTTGCTACC

TAAACATACATATATATATATTTTGTGAGGTATTTTTGCTATATACATGCATATCCAAGGTATCTTGCTACCTAAACA

TAGATATATATATATATATTGTGAGGTATTTTTTTGCTACCTAAATTACATACATGTATATCTAAGGTATTTTCGCTACCT

AAACACACATACATATATTTTGTGAGGTATGACTACCTTCCGAGCTTGTGCTTGTTTTATTTAAATTCCTAGGATCAT

GAGCAACTAGGTGTGTCCTACTATGACTTGAGAAACAAAGGTGATCAAATAACAAGCAGAGATTTAAAAAGTACTA

GGTTGCCTCCTAGTAGCGCTTCTTTAACGTCTTGAGCTGGACGTGTGATGACTTGTCGATCACAGACCTAGTACTTTT

GCTTACCTTTGGCTTTGGAATTGGTCGCCTGCTGGTCGGTCATGGGTCGTAGGCAACGCTCCAGCCTTTGTAGATGAG

TTGAGGGGCTCTGGAGGTGGTGGCGGTGTATCTATTGCCCGCTGCCGTCCATCCCTAGGCTGCTGTGGTGTCTCGCC

CTGCGCCTGCCTGGGGGCGCAATACTTCTTGATGAAAGCTTTGGTTAATATGGGGCCTGATGACCTTGTTGGGGGCGA

CGGGCACTCCGTAGAATTGACAAAGGCCCATAATCAGAGCTGGAAACCTCAGGACCCTGTTGGACTTCTCCGGGTC

CACTGGTGTCTTGCAGGCGCGATCCCTGCAAATATTGGATGACATCAGAAATCAATTGAGAGATGTGCATAGTTACC

TATGTCACGATGGGGTGACCTTACTGGGGGGGACGGACACCCTGTAGGACTGACAGAGGCCCGTAACCAAAGCTGG

AAACCCCAGGGCCCTGTTGGACTCCTTCGGGTCCATTGGGTGTCTTGTGGGCACGATCCCTGCAAATAGGGGATGGC

ATCAGAAATCAGTTGAACCACGTGCATACTTACCTATGTTACGATGGCATGAGCTTGCTGGGGGGGACGGGTACCCT

GTAGGACTGGCAGAGGCCCGTAACCAGAGCTGAAAACCCCAGGGCCCTGTTGGACTCCTTCGGGTCCACTGGGTGT

CTTGTGGGTGCGATCCCAACTGATACTTCCATAGGGGGAGTTCGACATTGTGGTCACTGGGCAGAATGTTGCTAAGT

AGCAACGTCATTCATATCTGTGTAAGAGTGGTCATGTTGGTGCGCATGATCTGCACTCGTCTCTTTGCAGTGGCACG

GGAGAAATCTTGCCCCGGTATGCACAGTAGCTGCGCGATAGCCTCCTCCTCTGGTTGTGCTCGCATAGTTGGCCCTC

CTCCAGGATCAAGGGGTGGCCCAGGAGCTGATAAAAGGAAACTACTGGCCCCTTAACCGGGAGCGCAAGTCTCGGT

TAAGCATTAAGGGCAGAGGACCTTAAATTCTCTAAAGGTGCGGATGTGGAGCCCACTGAAAGTGAGGACACATCGC

CCTCTAAAGGCGAGGGCGTGCAGCCCTTTGAAGGCGAGGATGTGTAGTACTCTGAAGGCGAGGATGTGTAGTCCTCT

CTAGGTGAAGGCATGTAGCCCTCTGAAGACGAGGGCGTGTAGTCCTCTGAAGGCGAGGGCGTGTAGCCCTCTAAAG

-continued

ACGAGGACGTGCAGTCCTCTGAAGGCAAGGACATGTAGTCCTGTGAAGGCGAGGACGTGTAGTCCTGTGAAGGCGA

GGACATGTAGTCCTCTGAAAGGTAAGGACATGTAGTCCTTTGAAGGCAAGGGCGTGCAGCCCTCTGAAGGCGAGGG

CGTGTAGTCCTCTGAAGGCGAGGGCGTGCAGTCCTCTGAAGGCGAGGACGTGCAGTCCTCTGAAGGCGAGGGCGTG

CAGTCCTCTGAAGGCGAGGACGTGTAGTCCTCTGAAGGCGAGGGCGTGAAGCCCTCTAAAGGCGAGGACTTGTAGC

CCTCTCAAGGCGAGGGCGTGCAGCCTTCTCAAGGCGAGGACGCGTAGTCCTCTAAAGGCGAGGGCGTGTAGCACTC

TAAAGACGAGGACGTGCAGTCCTCTGAAGGCGAGGACGTGCTATCCTCTGAAGGCGAGGACATGTAGTCCTCTCAA

GGCGAGGGCATGTAGCCTTCTAAAGGTATGGACACGTAGTCCTTTGAAGGCGAGGGCGTGCAACCCTCTGAAGGTG

AGGATGTGTAGTCCTCTGAAGGCGAGGGCGTTCAGCCCTCTAAAGGCGAGGACGTGTAGTTCTCTGAAGGCGAGGG

CGTGCAGCCCTCTGAAGGCGAGGACGTGTAGTCCTCTGAAGGCGAGGGCGTGAAGCCCTCTGAAGGCGAGGACTTG

CAGCCCTCTAAAGGCGAGGGCGTGCAGCCCTCTCAAGGCGAGGACGTGTAGTCCTCTCAAGGCGAGGACATGTAGC

CCTCTCAAGGCGAGGGCATGTAGCCCTCTAAAGGTAAGGACATGTAGTCCTCTGAAGGCGAGGGCGTGCAACCCTC

TAAAGGTGAGGACTTGCAGTCCTCTCATGGCGAGGGCATGCAACCCTCTCAAGGCGAGGATGTGTAGTCCTCTGAA

GGCGAGGGCGTGCAGCCCTCTAAAGGCGAGGACGTGTAGTCCTCTGAAGGCGAGGGTGTGCAGCCCTCTGAAGGCG

AGGACATGCAGTCCTCTGAAGGCGAAGGCGTGAAGCCCTATGAAGGAGAGGACTTGCAGCCCTCTCAAGGCGAGGA

TGTGTAGTCCTCTGAAGGCGAGGACGTGCAGTCCTCTGAAGGCGAGGGCGTGCAGTCCTCTGAAGGCGAGGGCGTG

CAGTCCTCTGAAGGCGAGGACGTGCAGTCCTCTGAAGGCGAGGACGTGCAGTCCTCTGAAGGCGAGGACGTGCAGT

CCTCTGAAGGCGAGGGCGTGCAGTCCTCTGAAGGCGAGGACGGGTAGCCCTCTCAAGGTGAGGACGTGTAGTCCTC

TCAAGGCAAGGGCATGTAGCCCTCTCAAGGCGAGGGCATGTAGCCCTTTAAAGGTAAGGACATGTAGTCCTCTGAA

GGCGAGGACGTGCAACCCTCTGAAGGTGAGGACTTGCAGTCCTCTCATGGCGAGGGCGTGCAACCCTCTCAAGACG

AGGATGTGTAGTCCTCTGAAGGCAAGGACGTGTAGTCCTCTGAAGGCGAGGACTTGTAGTCCTCTGAAGGCGAGGG

CGTGTAGCCCTCTGAAAGTGAGGGCGTGTAGCCCTCTGAAGGCGAGGACGTGTAGTCCGCTAAAGGCAATAGGTTC

TAGTACCGAAGGGTCCACCCCTATGAGAAAGCAAAAGATTGACTCATCGAGAGAGCCTTTCATCCCAAATTAAAAG

TTGGGACATTAGATGTTGGAAATCTATGTAGTTAACATGATTTTTAGGGATGCAGATGCATGCAACCTTTGTCTTGAA

ATGCGGACTTCGTAACCATCATTGCCCCAGTGTAGGGCTTTGAGGTAACCATCATTGTTTTGTTTCCACAACCTTGTA

GCAAGGAAGAATGAAAGAAGCAGTTGATTCTTGCAAAAAGAATTTTCCAAGGACAAGAAATAGTCAAAGGATTTTT

CAGTTGACGGATTAAGTCAAATGACTCCTATTCTTGATAACTCACTTATCTCTAAAAAAGACAAACTTTCCGGAATG

ATAAAATGAGTCACATGAATGTCTATATTTTACTTGAAAACACAGTCAATCAAATGCTTTTTTCCTTTTCTTTTTTCCT

TTTCTACTTTACTCGTTGTTTACGGCATCCTCACCAAATGTGTAGCACGAGTAATTTCTAATTGAACGGTCTTGGAAG

TCCAAACTCAGGAGTGCATGTCGCTTGAGCAAACAAACCAATGGCTTGCACCCACATTCCAGTGGAAGCAAAGATG

TAATTACGAGAGGATGAGGGACAAAGATGTCAAATTTATTCATTTTATTTAGCATTGTAACTGTGGTTTACAATAATG

GCATAAACTTGAAAATCCTGATGAGTCATTAGAGACATCTAACAAAAGCTTTCAAATATCTTATAAAGTTTTTAAGT

AAATATTACATCTTGAAAATTATGTATTTCTCTCTGGTAACCGATTACTAGAGGCTGTAATCGATTACCAAAAGAAA

AAATGTTTTTTAAACAACTTTCAGAAAAGTTTAAATTTGAATTTTAAAATCTATAATCGATTATCACTATTGTGTAAT

CGATTACCAGTCACAAAAGGTTTTGAAATTCAAACTGAAAAGTCATGACTCCACAAAATTAACTGTGTAATCGATTA

CCACATATCTGTAATCGATTACCAGTGAGGAAATTTCAGAAATAACTCTAAAAATTCACAACTCTTCATAAATTTTTT

TGAAAGGTCACCAAAGGCCTATAAATATGTGACTTGTGTTCGAAATTCTTCAGAGTTTTTCAAAACATTCATTGTCCT

ATCCTCTCACAAGAAAACCTTTAGCCAAACACTTGCAAAATCATTAAGGATTCTTATAAGTTCTTCAAGTTGTATCAT

TCTTCTCTTAAAGAGAGAAAAACATCTTATGTACTTCAAAAGCAATCTGTTGTTGTAATCAAGAGGTAGTGGGTCTCT

TGATTTGTAAGTTCTCTGAACACAAGGGAAGGATATCCCAAGGTGGTTCAGAAGTTGTAAAGGAATTTACAAGTATA

GTGGAAATCTCAAGTGAATTACTTGAGGACTGGACGTAGGCACAGGACATGGCCGAACCAGTATAAAACTGAGTTT

-continued

GCAATTCTCTCTTCCCTAAACTCTTTTACTTTATTGCAATTATATTTACTTTGCATATTCAAAGAAGCATCAAGTAAA

TTGTTTATTACTTCTTTTTTCTGCATATTAAGTCTACATATTTCTTTTAAAGAGAGAATTAAAACTTGTTAGGAGAAAT

TTTTTAAACTTAATTCACCCCCCCCCCCCCCCTCTTAAGTTATTGAGTTTACTTGTGTAACAAGTGGTATCAGAGCTT

AATTCTTGTATAAGGTTTAGAAACTTCAAGAATAGTTATGGCCTCATCAAATTTTTTATTTCCCGAAGAGAACTCTAT

AAATAGGCCTCCTATATTCAATGTTGTGGGTTATCATTACTGGAAAACCCGAATGCAAATTTTCATAGAGGCTATAG

ATTTAAACATCTGGGAAGCCATAGAAATTAGTCCTTACATCCCTACTATGGTAGCAGGAAATGCAACTATAGAAAAA

CCTAGGGAACAATGGGATGAATAGGAAAGAAAAATGGTACAATATAATTTAAAAGCCAAAAATATAATTACATCTG

CATTAGGCATTGGATGAATATTTTAGAGTATCAAACTTCAAGAATGCGAAAGAAATGTGGGATACCTTACAAGTAAC

CCATGAAGGAACAACATATGTAAAAAGGTCTAGAATAAATACCCTAACCCATGAATATGAATTGTTTAGAATGAATC

AAAATGAAACTATACAGGATATGTAAAAGAGATTCACACACATAGTAAATCATCTTGCATCATTAGGAAAGATATTT

CCCAATAAGGATCTTATTAACAAAGTTCTAAGATGTTTAAGCAGGAAATGGCAACCAAAGGTAATGGCTATTACAGA

ATCAAGAGATCTTATTAACATGTCTCTTGCAACTTTGTTTGGAAAACTTCAGGAACACGAAATGGAACTCATGAGAC

TAAATCAACATGAGGAAAATGGCAAGAAAAAGAAAGGAATTGCACTTAAAGCTTCATCTTCAATTCAAGAAGGAGG

TGATAAAGAAGATTTGAATGAAATAGAGGAAGATGAGGATTAGTTTCTTCGTAAAGAGGTTCAATAAATTTTTAA

GAAACAAAGGAAATAAAAAAAGATCAAATTTCAAACCAAAAAAAAAGAGGAGAAGATTCACCCTCTCTTCCAAAGT

GTTATGAATGTAATCAACGAGGACATCTGAGAGTTGATTTCCCAAGTTTCAAGAAAAGAATAGAAAGATCTGAAAA

GAAAACCTTCAATGATAAGAAAGCAAAGAAGGCTTACATCACTTGGGAAGACAACGATATGGATTCATCCAAAGAC

TCAAAAAATGAAGTTGTGAATCTAAGTCTGATGGTAAAAAATTATGAAAGCGATGAAGAGGTAACATCTTCTAACA

ATAACTTATCTATTTCCTTTGATGAACTTCAAGATGCATTCATTGATTTACATAAAAAATCAGTCAAACTTGCAAAAC

TAGTTTCATTTTCTAAGAAAACTATTCAAAATTAGAAAAGGAAGTTTTAAAATTAAATGAAGAATTAGAAAATCTT

AGAACTGAAGTCAAAACTTTAAAACCAATTGGCACAAATCAATCTTCCACCATAAAAGTAATAAATGATAGTAAAA

AAGCATGTAATTGTTGTAGCAAGTTTATAGAAGAAATCAAGGATCTAAAAAATTCTCTTTCCAAATTTATTGTTGGCA

AAAATAATCTAGATATTATATTAGGAAAGCAAAGATGTGTGTTTGATGAGGCTAGATTAGGATATAGACCTGATAAA

CAACAAAAGTTATATAAAAAATTCTTTGCATCCAATCAAAAGAATAGTTCTCCTTTCTTAACTTGTTTTTACTGTAGA

AAGAAAGGACATGGTGCATCTACATGCTATTTTAGGAAAAATAATAATAATATTAAAATGATATGGGTTCCAAAAGG

ATGTTTTTATCAAAACTAACATTCAAGGATCCAAGAAAGCTTGGGTACCTAAGTCATAAACATGATCATATAGGTTT

CTTTGAAGAAGAGTTGGTACATAGATAGTGGATGCTCTAAACACATGACGGGAGATGCATCAAAGTTCACTCATATT

TCTCCCAAGAATAGTGGACATGAGACTTATGGCGACAACAATAAAGGTAGAATCCTTGGAGTCGGAAAAATAGGTA

TGAATTCATCTACCTCCATTGAAAATGTTATACTTGTTGATGGTCTTAAGCACAGTTTACTAAGTGTTAATCAATTAT

GTGATAAAGGCTATCTAGTATCATTTGAATCTCATAACTGTGTTGTTGAAAACAAACATGATAGAAATATAAAACAT

ATAGGCTATAGATTAAATAATGTTTACATGATAAATTTAAATAAAACATTAAATCATGATCAATGTTTTCTTAGTAAA

GATGATAATCCTTGGTTATGGCATAGAAGAATTGCCCATATAAACATGGAACATTTAAATAAACTAATTTCTAAGGA

TTTAGTTATTGGTTTACCAAAACTTAAATTTGAAAAAGATAGATTATGTGACGCTTGTGAAAAAGGAAAACAAGTAA

GGGTTTCCTTCAAATCAAAGAATATTGTGTCTACAACTCAACCATTACAACTTTTGCATATGGATCTTTTTGGCCCCT

CTAGAACTATGAGTTTTGGAGGAAACTACTATGCTCTTGTTATAGTTGATGATTAATCAAGATTTACATGGACATTAT

TTCTCACTCATAAAAGAGGTGTTTTTCATGCTTTCAAGAAACTTGCTAAAATTATTCAAAATAAGAAAAATCTCAAA

ATTGTATCTATTAGGAGTAATCATGGAGGATAATTTGAAAATAAGGATTTTGAATCATTTTGTGATGAAAATGGCATT

GGACACAATTTTTCTGCACCTAGAACCCCTTAACAAAATGGAGTAGTTGAGAGGAAAAATAGATCTTTAGAAGAAAT

AGTCAGAACTTTGCTTAATGATGCAATCCTTCCTAAATATTTTTGGGCTGAAGTTGTAAATACTGCATGCTATATAAT

GAATAGAGCTTTTAATTAGACCAATCTTAAAGAAAACTCCATATGAATTATATAACAGAAGAAAATTGAACATTTTCTC

-continued

ATCTTCATGTGTTTGGATGTAAATGTTTTGTGCTAAACAACGACAAAGAGAACTTAGGTAAGTTTGATGCAAAATTTG
ATGAAGGTATATTCCTTGGCTATTCCTTGCACAGTAAAACATTTAGAATTTATAACAAAATAACTATGATCATTGGAT
AATCTATCCATGTTGCTTTTGATGAAACTAACTCAACTGTGCCTAGAAAGGATACTCTAGATGATTTTCAGATTCTT
TAGAAGGTATGCATATTCATGGTGAAGAGCACAAAGGAAAAGGAAAGGGAAATGATGAAAAATTTCAAATTGATGA
AACAAAAACAAGTACAAATCTTCTAAGAGAGTGAAGAACTTCTAGATACCATCCGCTTGACAACATAATCGGTGAC
ATATCTAAAGGGGTAACAACTAGACACTCTCTCAAAGATGTTTGCAATAATATGGCTTTTGTTTCTTTGATTGAACCT
AAAAATTTAAAAGAAGCCATAATTGATGAACACTGGATCATAGCTATGCAAGAAGAGTTAAATCAGTTTGAAAGAA
ATAAAGTTTGGGAATTAGTTGAGAAACCTGATAATCATCCAGTTATAGGAACTAAATGGCTATTCATAAACAAATTA
GATGAACATGGAATAATAATTAAAAATAAGGCTAGGCTAGTAGCCAAAGGATATAATCAAGAAGAAAGAATAGATT
ATGAGGAAACATATGCTCCAGTAGCTAGATTAAAAGTCATTAGAATGTTATTAGCCTTTGCATCCATAATGGACTTC
AAACTTTGGATGTGAAAAGTGCCTTTTTAAATGGTATTATCCAAGAAGAAGTATATGTGGATCAACCTCCTGGCTTTG
AAAACTCAGAAAAGCCTAATCATGTCTTTAAACTGAAAAAGGCTTTATATGGTTTAAGCCCCTAGGGCTTAGTATGA
ACGTCTGAGTAAATTCCTTTTAGAAAAGGGTTTTTCAAGAGCTAAGGTTGATACTACCCTTTTTATTAAAAGAAAATT
GAATTATATACTCTTAGTACAGATCTATGTTGATGATATCATTTTTGGGTCAACTAATGATTCTCTTTGCAAATAATTC
TCGCAAGATATGCAAAATGAATTTGAAATGTCAATGATGGGCGAGTTAAACTTTTTTCTTGGACTACAAATCAAGCA
AACAAAGAATGGAATATTTATTAGTCAATCAAAATATTGCAAAGACCTGATTCACTGATTTGGGATGGAAAATGCTA
AACACATGACTACTCCAATGAGTACTGCTTGCTATCTGGATATAGATGAAATCAGTCAGTCAATAGACATAAATAAA
TATAAAGGTATGATCGGATCTCTTCTTTATTTATCTACAAGTAGACCTGATATAATGTTTAGTGTTTGTATGTGTGCA
AGATTTCAAGCAAATCCCAAAGAATCTCACCTTAGTGCAATTAAGAGAATCATGAGATATCTATTAGGCACTATTAA
TCTAGGGTTATGGTATCCTAAAAATTCTACTTATAATCTAATAGGATACTCTGATTCTGACTTTGTCAGATGCAAAAC
TGATAGAAAGAGCACTAGTGGAACTTGTCATTTCATTGGCTCTACTCTAGTTTCATGGCATAGTAAAAAACATAATA
GTGTTGCTTTATCCACTGCTGACGTGGAATATATTTCTTCTGGCAGTCGTTGTGCACAAATACTTTGGATGAAACAAC
AACTTTCTGACTATGGATTAATTCTTGATCATATTCCTATTTGATGTGATAGTACGAGTGCAATAAACCTATCTAAAA
ATCCTATTCTGCACTCGAGAACCAAGCATATTGAGATTAGGCATCATTTCTTGAGAGATCATGTTCAAAAAGGGGAT
TGTGTACTAGAATTCGTTGACACAAAGAATCAGTTAGCTGATATCTTTACAAAACCTCTCCCCAAAGAAACATTCTT
TGTTATTAAAAGAGAATTAGGACTCCTAGATATCAATGACTTAGATAAATAGTTAATTTGTTTGTTTATTATTTTTTCT
TTTGGTTGTTAACTTTTGATTGTCCTTGCTGATTGTGTTTGCTTTTGATATTTATTGTTGATTAAGGTTTAATGATTATT
TTTGCTTGAGTTTTTGAGTGTCTTTGATGATTATGTTTAATAGTTATGGTGATTCTTTGATTTGTTGTTGATGATTATTTT
TGAAATTTTGATTGTCTTTGATGAATGTGTTTGAGAGTTTTTATGCTTATTTTGATTATTTTGATTGTTGATTGTTGTTG
ATGATTGTTATACTGAGTGTGTAAGTTTTTGAGTGAAAAATACTTTAGTTTTAATGAAAAATCTATGTTTTTAGGGTCT
GGTAATCGATTACCACTCCCTGTAATTGATTACCATAGAACATGACCCTATAATCAATTACAATAGACTGTAATCGA
TTACTAGAGGGTTTGGTCAGATATAGGTTACGCTTGTAATTGATTATCATGGGCTATAATCAATTACAGCTCGTCCCT
GTCTATAAATACTGCATTTTTCTCTCTCCTTGTGCAACCCTCTTCTCCCTCACTCTCCTTGACGGCGCCCCTTCCTCTC
AAAACTTCAAATCACCATAACTTTCTCGTTTCTTGTCCAAATCACTTCAAACAAAGCTCAAATTTCTTCTTTTTCAAT
TCTCTACAAACTCCACTGATCATAATTTTCTTAAGAAAGCTCAAATTGCAAAACCCGCAAAGAAGAGAAAGGACTC
ATCCTCCACCACCACCACTGCAGGCCAACACTGCCACGGCACATCCGGTGACCCACTAGCACCAAAACCCCCTTCT
TTTTCATCTCCCAAGTCATTGACTCTATTTTCTTCCAATGACCAACTTCAAAGGTACTATTCCCAATTCTCCAATTGTG
CCATTCTCGATCCTAAGTATTTAGATGTAGAATTCTTTGATGGGGAAACCTTTGATTGCTATCAAGTGTTTCAAAATT
CTGAATTAGTTGAGTTTATGTCTCTAAAATTACCATATTATCCTGAATTAGTTAGAGTCTTTTACAATAATCTTAAAAT
TCAGGATGAAGTCATTTTTTTCTGAGGTGCATCAAATACCTATTGTTGTTGATCAATCTCTATTTTATTCTCTGACTAAA

-continued

CTGAGCAGTCAGGGTGTTCCTTTTGAAGGCACTCTAGTTGATGATTGGAAGCATGTTTATTCTAGTCATGATGCTCGT

AAAATGGTCTGTAATGACCATACTGATATGACCGGTAGATTGCTTGCTAGCTCATTCACCTTTGAGTGTCGCATCATG

CATTATATCCTTTTTTGAGTCTTGCTTCCCCGGTTCACCAATCTTGCTCAAGCCTTTAAGGAGGATTTAATCTTGCTAT

GGGCTCTTCAAATCGGTCGCCAAATGGATTGGGCCCATCTTGTTAGGTACCAAATGCATAAGGCATTACGAGTCAAT

GCACCTCTTCCATATCCTCATCTTGTCACTTTGTTTCTTCAGCATTTCAATGTTCTTTTAGAGGATGAACCTTTTGTTA

AGGTTAAAAGATCCTTTGCTATTGGTGTTGGTGCTATTACCTCCTTCGGATACCAGAAGGATATGGATGGCCAATGG

GTGTATAAACTGTAGAAGCAAGCTTCATGATGATGAATCAAGTTGATTCAAGATGTTTTGATGATAACAAAAGATGA

TGACAAAAAGCCCAAGAGAATGATTTCAAGATTGAGTCAACAATTCAAGAATCAAGAGAAGTTTGATTTCAAGATT

CAAGAGAAGATGAATTCAAGATTCAAGAGAAGAAATCAAGAAGACTTCACAAGGGAAGTATTGAAAAGATTTTTCA

AAAAAACAAACATAGCACAGTTTTGTTTTTCAAAAGAATTTCTCAAATTTTCTAAGTTACCAGAGTTTTTACTCTC

TGGTAATCGATTACCAATTTCCTGTAATCGATTACCAGTGGCAAAGTTTGATTTCAAAATTTTTCAACTAAATTTGCA

ACGTTCCAATTGATTTCAGAATGGTGCAATCGATTACAAGATTTTGGTAATCGATTACCAATGCATCTGAATGTTGGA

ATTCAAATTCAATTGTGAAGAGTCACATCCTTTCATAAAATGCTTTGTGTAATCGATTATAAGGATTTGGTAATCGAT

TACCAGTGACAAGTTTTGAACAAAAATCAAAAGATGTAACTCTTTCAATGGTTTTCAGATTTTTCTAAAGGTTATACT

CTTTCAATGGTTTTCCTGACCAGACTTCAAGAGTCTATAAAAGCAAGACCTTGATTTGCATTTGAAATAATACTGACA

ACCTTTACAAACAACTTTTCCACATATTCTTTTACAACCTTTGAATTTCTTTGAACATTTTCTTGAACTTCTTCTTCTTC

TTCTTCCTTTCCAAAAGCTTTCTAAAGTTTTCTGGTTTTTCCAAACCTTGAAAATAGAAGTGTGCTATATCTTTTATTC

TCTTCTCCCTTTGCCAAAAAGAATTCGACAAGGACTAACCGCCTGAATTCTTTTTGGGTCTCTCTTCTCCCTTTTCCA

AAAGAACGAAGGACTAACCGCCTGAATTCTTTTGTGTCTCCCTTCTCCCTTGTCAAAGAATTCAAAACGACATAGTC

TGAGAATTTTTTTTATTCTTCCTTTTCCCTTAAACAAAAGAATTCAAAGGACTAACCGCCTGAGATATCTTTTGTTTCC

CCTTCACAAAGTTTTCAAAGAACTAACCGCCTGAGAACTTTGTCTTAACACATTGGAGGGTACATCCTTTGTGGTACA

AGTAGAGGGTACATCTACTTGGGTTGTTGTAACTGAGAATAAGAGAGGGTACATCTCCTGTGGATCAGTTCAAGTGG

AGGGTACATCCACTTGGTTGTTCAAAGAGAACAAGGGAGGGTACATCCCTGTGGATCTTTGCTTGTAAAGGATTTT

ACAAGGTTGAAAAGAAATTTCAAGGACCGTAGGTCGCTTGGGGACTGGATGTAGGCACGGGTTGTTACCGAACCAG

TATAAATTCTTGTGTTTGTCTTCTTCTTCCCTGCACTCTTTAATTTCCATTGTGCACTTTAATTATCACTTTTACTTTTG

GTTAAGTTTCTATTTTGTTCTTTACTTTCTTAACATTATAGTAAAAGCCTAATCGAATCTAGTAATATTAAGAAGGAT

AGATTTTTAATTAGTAAAGGTTCACTAATAATTAATTCAACCCCCCCCCTTCTTAATTATTCCGAGACCACTTGATCC

AACATAAACAAGACCTGCCACCTCCCATTCTCGATGAACGCACACCCTCTCTACCACCGCAACAAGATACCTCCTCT

TCCTTATTGAATGACGTCCTAATTGAGTTACAGGTGTTAGATCAAGTGGCCTCATAATAATTAAGAAGGGGGGTTGA

ATTAATTATTCTTAAACCTTACTAATTAAAAATTTACTCTTCTAAGGCTTTTACTTATGTTGTTAAGAGAATAAATAG

TAGAAGAGAAACTTAACCAAAAGTAAAAGCGGAAATTAAAATGCACAGTGGAAATTAAAAGAGTAGGGAAGAAGG

AGACAAACACACAAGAGTTTTTATACTAGTTCCACAACAACCCGTGCCTACATCCAATCCCCAAGCAACCTGCGGTC

CTTGAGATTTCTTTCAACCTTGTAAAAATCCTTTTACAAGCAAAGATCCACAAGGGATGTACCATCCCTTGTTCTCTT

TGAACCTAGTGGATGTACCCTCCACTAGAACTCTATCCACAAGAGATGTACCCTCTCTTGTTCTCAGTTAAACCCAAG

TAGATGTACCCTCTACTTGTACCACAAAGGATGTACCCTCCAATGTGTTAAGACAAAGATCTCAGGCTGTTAAACCT

TTGATACTTTGTGAATGGGGATACAAAAGAATTCTCAGGCGGTTAGTCCTTTGAACACTTTTGTATAAGGGAAAGGG

AAGAATCAAAAAAATTCTCAGACTGTGTCGTTTTGAATTCTTTGACAAGGGAGAAGGGAGACACAAAAGAATTCAG

GCGGTTAGTCCTTTGTTCTTTTGGAAAAGGGAGAAGAGAGACACATAAAGAATTCAGGCGGTTAGTCCTTGGCGAAT

TCTTTTTGGCAAAGGGATAAGAGAATGAAAAGATGAATAGCACAAGTTTTCAAGGTTTAGAAAACCAGAAAACTTT

GGAAAGCTTTTGGCACAAATAAGAAGAAGAAGTTCAAAGAGATTCAAGGCTTGTAAAGGATTGTATGAATTAGTGT

-continued

ATTGAAAAGAAAATCAAAGCCTTGCTTTTATAGACTCTTCATGTTTGGCCAAGAGGACCATTTAGAAGAGTTATAAC
TTTTAGAAAAACTTAAAACCAATTTGAAAAAGTCAAAAACCTTTTGAAGAGTTACATCTTTTGATTTATTCAGAAAC
AATCACTGGTAATCGATTACCAAATCAGTGTAATCGATTACACAAGGCTTTTATGTGAAAGGATGTGACTCTTCACA
TTTGAATTTGAATTTCAACGTTCAAAGGCACTGGTAATCGATTACCAAAACATTGTAATCGATTGCAGATTTTTGAAA
TTAATTGGAACGTTGTAAATTCAATTTGAAAACTTTTTCAAAAACATTTTGCTGCTGGTAATCGATTACAACAATCTG
GTAATCGATTACCAGAGAGTAAAAACTCTTTGGTAAACATGTTTTGAGAAAAATCATGTGCTACTCAATTTTTGAAA
AAAAAAATTCATACTTATCTTGATTAAGCCTTCTCTTGATTCTTGAATCTTGATCTTGATTCTTGACTCTAAACTTTCT
TCTTAAGTCTTGAATTCTTCTTGATTCTTATCTTGAACTCTTGAATTGTTCTTTGATTCACTTGAGTTGTTCTTTGATTGA
TCTTTGAGCTTTTTGTCATCACCTTTGTCACCATCTTTTGTTATCATCATTGTTATCATCAAAATACCTTTGAATCACC
TTTTTGTCATCACCTACGGATTCTTAGACGTTTCTAGTATTATAAGTCCTTAATTTTCTAGACATTTTACTATTTGTGC
CCTGTATTTGGATTTTGTTATTTATCACTTTGGTTAATTTTGTGCTTTGCTTTGGATATTTAGCATTTGGCCGGTTTATG
CCTTGCTTTGAATATTTTGCACTTGCTTCTATTTTATATTTTGCTATGGATGATTAGTTTTTGTTGTTGGTTGTGATGCT
TGCTCTAGATATTTTGTGGCTTTGATATTTTCTTCTGTCTTTTTCAGCTTTTTGATGTTTCCTAAGGGTAGAGAAACTA
AGGGTGGATCTTATCTAAAACTAGGCAATAAATTGCAAATTTAAGGGGGAGTAAGGGTGAGTGCATGCATTGCAAA
TCGAATATCGTTTATCTTGTTTTCAGATTGTTGTCATCATCAAAAAGGGGGAGATTGTAAGTGCATATGTTGTATGAA
GATTTTGATGATGCCAAAAGATTAAAGCTATTCAACGTTGATTCAAGTCAAGATCAAGAAATCAATAGAAACAATTT
ACAATAGTCCTTTATATGTTAAAAGAATCTCTTAAAAAGGTTACAAAGGTTTGGCCTTAAAAGACTTAAGTTTTCAA
ATATCTTATAAAGTTTTTAAGTAAATATTACATCTTGAAAATTATGTATTTCTCTCTGGTAATCGATTACAGCCTGTTG
TAATCAATTACCAGAAGCAAAAATGTTTTTCAAAAAGCTTTCAGAATCAATTACCAATCACAAAAGTTTTTGAAATT
TAAATTGAAAAGTCATGATTCCTCAAAATTAATGTTTAATCGATTACCACATATCTGTAATTGATTACCAGTGAGGA
AATTTCAAAAATAACTTTGAAAAGTCACAACTCTTCACAAAGTTTTTTGAAAGGTCACCAAAGGCCTATAAATATGT
GACTTGTGTTCGAAATTCTTCAGAATTTTTCAGAACATTCATTGTCCTATTCTCTCACAAGAAAACCTTTGGCCAAAC
ACTTGCAAAATCATTAAGGATTCTTATAAGTTCTTCAAGTTGTATCATTCTCTTAAAGAGAGAAAAACATCTTTTGTA
CTTCAAAAGCAATTTGTTGTTGTAATCAAGAGGCAGTGGGTCTCTTGATTTGTAAGTTCTCTGAACACAAGGGAAGG
ATATCCCTGGGTGGTTCAGAAGTTGTAAAGGAATTTACAAGTATAGTAGAAATCTCAAGTGGATTACTTGAGGACAG
GATGTAGGCATAGGGCATGGCCGAATCAGTATAAAACTGAGTTTGCAATTCTCTCTTCCCTAAACTCTTTTACTTTAT
TGCAGTTTAATATTTACTTTGCATATTTAAAGAAGCATCAAGGAAATTGTTCATTACTTCTTTTTTTGCATATTAAGTC
TACATATTTCTTTTAAAGAGAGAATTAAAACTTGTTAGGGGAAATTTTTTAAACTTAATTCACCCCCCTCTTAAGTTA
TTGAGGCCACTTGTATAACAAGTAAGGTTGCATTTTCCTTATAACCACAATTTCCATTAGGTCTAATGTCAACAACTT
TTACATGAACTGTTGCAACAGATAGGGAAAATTCATTCATATAAAGGATTTTTTTTGTCCACTTTTTGCTACTGACT
TCTTTGCGAGCCACACTTGGTGTTCTCAAACTACCAACCATCATGTTTCACCAACTCGTTCTCACATTAAAGGAGCA
CATTTAGTAGATTTCACAGACTTCAATGCACCCTTTGTTTTTACTTTCTTTGGAGGCAAACTTATTAAAGTGGTATCC
GAAAATGCAAGTTCATGGACCTTATTCTTTAATGTCATTTTTATGCTCACATCAAGCTATGAAAATCTCTTTACCAAT
GCATCAACCTCATTTGTGAGAGTTAAGTCCCCCCAAGAATCACCTGCGTTGTGTGTACCATTGATGAATAACATCTT
CCAATGCACATGAATGGACAACAAGGGTATTGAACCATTGATTTGGCTATACCTAGCAAGTTTATAGGCACACGGTA
AATCATGAATAGTTCTGAGTGTGCAGTCACAATTAAAACTGTCAACACTAATGGAAGCAAAGCGCTTCAACACAATT
AAAACTTTGTGCTTCGTAGTCTTTTGTAAAACGGTGTATTGAACTTGTGGTCAAGCACGTTGATGCTTTTTTGAAATG
ACGCCTTAAGTTCAGTATGTTGCAGTATAAGCATGTTATTCATTGCATCCCAGCAAATACACAAGTCTCCTATGCTAT
CATGAAACAACCTCTTTAGTCTTGCTTGTGCGCCTTCAACTCTGTAAAGTAGTTTAATGTAATATCAATAGAAGATAC
ATAACAAACAAAATGTGAAACAAGTAAGTAATTACAAAAATCTACCTATTAGTTGTGTTTCCAAGATGCATAACACA

-continued

```
ATCAGTTCATGCTTGTACAAATCTCTCCGTATAATGCAACAACCATGTATAATAAATATACTCTTGAAAATCCACAT
AATGTCTACAAATGCTTGTAAAGCTTTTTAACTACTACTCATATATTTGTTCATCAATAGAATTCACCAATCCTACCC
AAGCATTCATCACAACCTCCCAGTCTTCTGCATTAGTCACGAGTATCTTGCATTTTGCTCTGACATTCTTAGAAACAT
GGAATTAACATAACAAGTTGGTTGCAAAAGGAAAGGCAACCTCCAATGCATTCATCAAAGTAAGATCTTTGTTAGTG
ACAATCACCTGAGGCAGCATATCATCCTTCACAAACAATCCTTTGACCTTTTTTAAATCCCATTCAAAATTCTTCATC
CTCTAAAATTGTAAATAAGCAAATGCAAAAAAAAAAATCATTTCTGTTGAAGTCACACAACAATCTCCAATAGTGGA
AGATGATATTGTTCGTCTTCCAAGTAGTATCACAAATCAACATTGTGGGAATGCATTTAATAGCTTGATGAAATATG
GATGAGACTACATTATATCTTTGACAACATCTTGAGTGTCCACTCTTTTGAATCAATATACATATTGATTGTGCTCTA
TCAACTTTAGTAGATGTTGTACCTTCGTTCATGGACCCCTCACTACTAGAAAAAGCATTTTTCACATCAGTTCTTTAG
TACATTTCATGACGGTTCAAAAATCATCTTTGAAGTCGCCATCATGGAAAGTCAACACTTTCCACGATAGTTTTTAAA
CAGTCTTAGCATCTTGATTTCTACATCGGTTCTTTTTTAAACCATCTTAGAATGTGTTTTTTGTCTTAAAAATGTTTT
AAAAAAATGATATTTCTAAGACATTTTTCTGAAAGAATTATCTTGGAAAGTCTCTAAACAAACCAAAAATTTATTTGA
GGCTTATTATTTATGAATTAATTATTTAAAAATATAATATTTCTATTTGGAAACAAAATCATTGTTTATAATATATTGA
AAGTAAAATATAAACCTAAAATTATTTTATTTTTATTTAAATATAATTAAAAAGTTATAAATATAATAAAAGATTATA
TGTTTTGCATATGTGAATCTACAAACAATTTACAATAATAATAAAGGAGGTATATGATAATTTTTTTATATAAAATCT
ACCTAGTTTTTTCTTATCATGGAAATGAATGTAGTAGGATTTGAAATATATACATTCTCCACATACATATATATCATG
AAATGTGAACTACAAAGTTATTATCAATGGGGTTGACTACAAAAATTGAATGTGAAAAACAAACTAAATTTTTCTGA
AATTAAAGTTGTCCTATAAACTAAGTAGTTTCAAGAGAAAGATGAGAGTTAGCACTTAACATAATTTGTAATTAAAT
TATCACCATCAATTCAACGGTCAAGATTAATTTCTAATCGAATTGGGTTCATCAAAATAAACCTTCACCACCTCTAA
CCTCTTCAATTTTCAACCAAGGGTCAATAATTTCGCTGATCAACTCGATGCCTCTTCAATACACTACTCAAAGAGGTT
GATTCATCACCGCTGGGCAATGTAGAACTAAGCATCTCAGACGAAGATCAGGATGCCTCATCCTGTAACCATAAAC
AAATTGCAAAGATTAATTAATCAAGAATGAAAATATCCTCTAATAAATTTTTTAATAATGAAGTACTCACATTGTAA
GACTTTCATCTACTTACAAATTATAAAAGATCATTAGTATGATTTTTAAAATAATTTTATAAAAATCAATAAACTTAT
TATCATGTATATAATAATTTTTTATTGAATAATAATATAAAAACTTTCTATCTTTTCTTTATCTTTGAAACAAAATATT
AGCTTAATATCTAAAAGCATATTCAAAGTTAAAATAATAACAATGTCAAAAATGAAATCCTTGATAGATTTATAAGG
TAAAGTTTATTACTTAGAATAGACCATTACACCATTGGTATCACTGATTTACCGTATCAAGAAAATACAACCTCCCA
ATTGCAAGATATTATCAAAAAAACAATTAATAAACTAATCTAATATTCTAAAACAATTAGTCCAAACATTGCCACAA
AGAATATAAATTAAAATTTGCATAGTTGCACCATAGAGCACTCACTTAGTGAAAACCACAGAACGAGGGCGAAGTA
ATCTCGAACCTTACCTAGTGGAAAGAAGGCACAGATCTAAAGGAGATATAAACAAAAAGACAAAGAAGATGAAGA
CACAAAGCAGATTAAGAACCTTGTTACAACCCATTCCACAACACGTTTATATTTTGAAAAAAGAGAAAATAGTATAT
TAATTAGTTTTTTTCACCTTTTCAATCATAAATAATAATTAAATTCATTAATTTTAATCACAATAATAATTAAAAATAG
GTTATTACTTTTTAATTATAAATTTATGCTTAGAAAAATAGATCTCAAATAAGTTAGTAGGCCCTTCCCTACATAGCA
GACATTGTGGTCTGAGGGGAAAAAACCGTGAGGATACAAATCCTAGAAGCCTAATATAATCAAACTAAATAAGAAC
AAGATTTATATTTGAAGAATTTTGATCCATTAAACCACAAGGAATCAAGTATTTAAATAAGAAAGAATGGGCAATAA
GCAGTCACACAAGAAATTCCCTTGAAAGTACTTCTAATAATGGATAAGCATTGATCAAATGGCATAACAATTTTACA
CATAAAACAATTATGTTTCTTAATCAATGACAACTACTTTGGGGTCCACTTGTTAGATAAAATGCATCCATCCATAGA
AAAGGGGGTTATAAATTTATATATAATAAAAAAAAATCAGCATCCTTCGTTCAACGTTTCTCCAAGTCTTCCTGATC
TAGAAGTTGAAACTCTCATTCAAATCTCTGGATTAACCTGAACTTTGTTCTTTGCAAAGTATCTCATCCTATCCCTAA
CTATATTGTGTAATATTCGATAGTAGAAGCATTTCAAATGAAAAAAAAGGTAGACTTCTTTAAATCTTTCAGAAGGT
AGTGATTCTTTTGTCCGCAATGCGTATTGAGAAACACAACAATAGTAATGCTTTCAACTTTCATTTTAAAGGTGAAAA
```

-continued

AATATATAATAAAATTAAGTTTAAGCAACTTACTATGTATATACCAATAGTTATATATGTTAATGCTAGTTCATAATT

TCACTAATTAAGAGTGACAAGAACTACATTCTTTAAAACTGTTGACATCTTGCCCAATAGACATGAATAAAGCAAAT

TACAGATTTGACCAATCATATAGAGAAGCACACAGACCTAAATTATGAAAAATGAGATTGCACACAAAATTTGAAA

GTTATCTAAAAAATAAAAAATAAAAAACAGAATTTATCCAAAAATATCTAGTATGTACAACTCCTTTTATCCCTCCA

CTTTGTGCTAAATAGTAAAGAGGACAAAGAAGAGAATTTTGAGCTGATTGTGATGCAAATTCCCTACATACCTCTAA

TCCACGCAATGCACCAAAAATAGTATTTGCCTAGAATAAATAAAATCACAAAAAACTTAAAAGACTAATGGCCAAT

TAGAAATGACTATCATTAAAGAAATAAAAAGATAAACCACATATTGCAATTTATTTGTTTTTGTCCATTAACCATAA

GAAAGGAAGCACAACATCATAAGAGTCTTCTTTATCAATCAGTTTCTTTTCCCTAAAAACAAAACACTCAATGAACAA

GTGTTTCAACAAATTCCAATTGCTACTATGTGGCATTTTAGAATGGTGTTGATGGATTGGTTAACTTGTTCAATGCAC

AGAAAATTACGACATTAAACTAAGAAATACATATATAAAAGGAAACTAGTTTTAACTTAGGAAGGGAAAAGTACAA

CATAACCTTCAGAATTTAAGTATCCATTAGCCAACAAACAACATAATCTCATTGAATATTCAAATCCATTAACAAAC

ACTACCATAAAAATTATTTATTACGATGCGCCAACAAAGATGGTTGACAAAAATCATCTTTGAAGACAATGTGGTGA

CAATGTCATAATTAAGTTCATTAATAACGAAGACGATTTTCAAATAACCATCTTGGAATTGTGAATTTAAGGATGATT

ATTCAAAAAACCGTCGTAATTGAACACAATACAAAAATGGTTTTACAAAACTGTCTTTGAATGGTTTTGCCTTTTTCAA

ATTCACGCTTTCTCTCTCTCTCTCTCTCTCTCTCTTATCTTATCAGGTCTCTCTCTCTTATTCTCACTTTCTTTCTCTTGC

TCTCTCTATTGTGAAACCCTCATCTTCCCTTCCCTTCTACATTTGCAATAACAACAAATTTAATCATCTTCTCACTGAT

GAGTTCGTCCCTGTCAACACCAATGCCGACAAGCTCTACGATGAGATGCTCAACCTTCAGAACATTGTCGCCTTCCT

CCATCGCACCAAGATCAACGCCTCCACCGATTCCTCCGTCACCACCGGCTCCGACCTCTGCAACGTCATCACTGGCG

CCCGCTAGATCCCTGGCGAGTCACGCCTCAACCTCCTCTAGAGGAACTTCTCCCTCTTTCATGCCATCATTGCGCTTC

TCGTCCGTTACTCCCCCGACACCATTCTACTCATCATTTCCTACCTTGTCGACATTCTCACCTATGTCGCTTGGAAGC

TTGAGCTCATGTAGGTAATGAACTCTGAGAGTGCAAATTGATTTTTTTTCGCACAAAATAAGATGGTTTCCTATATAC

TAGCTTTGACATAATAAGTGGTATTGTGGTAGACTAACATTTTTTTATATATTTTCCATTGAATGCTCTTCTCCCCCAT

TAAGCTGTTCAAATTTCTATCCATTAAAAGCAGCCTCCTTTAAGTAGACTTTTCATCTTAGTAATAGGAAATGAAAA

GTCCCATTCATAATGACATTTGGAAACTATTACTTTTTGATTTGGAGATTAAGATTATCTTTTAAATGTTTTCTTCTTC

AAACATTTCAAATAGAACGCAATTCCCTTATAACATTTATATTTTTGGATAAGAAAATGGACAATAATAAAATAAGA

TGTGTGTTGTTAATGCTATTCTAGCTTTCTGGAAGCTCAAATCTATGAATTGTTTCAGATTTGATGTTTATATAGTTCA

TTTGTTTTTTTTTATTTTAGGCATTTGGTTGAATACATTGGGTTGTTCATTTCTGGTGAGCATGGCTTCTCTTGTTTGTC

TGATTATCCTGCCTGTAATTTTTGGTAAGTAATTTTTTTGTCATTTTGTACAATACAAATTATTTATTTCTCAATAGCA

AATGCTTATCTACAGAATACGAAATTGAATACTCAGGTTTATTCTCCTATTTCAGTACAAGGGAAACCATCAAAGGT

TGTTGTTGATTCATTGGCTTTATTTGGAAATCGTGAGTGCCAGCACAATGCTAAGGTAGTATTTTTTTTTTAATGAATC

TTGAGATTTTTGTCAGGGTTGGAATCAAACCCCCCAAGGTATATGACTTGAGATTAATCTTTCTTAAAAGGAAAAAA

GTACTAAATATATATGTTTCTCATATATAAGGGTGTTCGTCTTTATGGTATAAGGATTTCTAGTTATTTTTTCATAATA

ATCATTTCATTTATTTCTTTTTTCTTTATGATTTTGATAGATCACTTAATATATGTAACTTTTGTGGATTTTCTTGAATA

AACTTGTCACTGAGGAGGCTTTTGTTCCTATTGCTCCTAGCAACATGTTTTTCTGACCCATAAGTTGGTGAAATATAA

ATGGCCTATAATGATTTGCCAATCTCAAATGCTTCTAGTGCACTGGCTATTCTCAATTTTTTTGGATAATTATTAGTAC

ATGAAAAGAATAGACAAAAATAATGGAATTTCTTTTGGCATAATAAGGGGGAATTGTCATAAATCCATAAAAGAAT

ATTGTCTGGTTATGTTGAATTGCTCTTTTTTTCTTTCGTGTTGTGTTGTTTTTTACTTGTTAACTTGTTATTGAGTTTTTT

TTTTTTTTTTTTGCTGTGTTGTATGAATGAGATCAATGCATGCTATGAGAGATCGGATTGTTATTATTTTTATTGGTG

TGTTCAGAAACAACAATATTTATCAAGGTACCAAAGTATTTTTTTACCAAATTAGAAATTAACAAAGTAATTGTGAT

AATAGTCATTCACATTTATTGGGATTGTTTACAATTGTCTATTGGTTGAATCATTATTTGTAGTAAATATTAGATAACA

-continued

CAAGTATTTTAATATATAGCTTCAAAAGGTACAAGTGGAAGTGCCAAATTGTTGGAAAGGCTGGTATTTGTATTATT

ATTGGCTCCCATTTGCTCCTTTGATTATAAGCACATGCAATGCCTTAATTAGCTTAATTAATTATCATAATTAATGAA

TTAATCTAGTTTCTTTTGTCGTGAACATAAATGATATTTTGTGTAATTATAGCTTCTCTTAATTAAAATGTAGGTTGTT

GTATTGAAATGGTAGAAAATTCCTATGGATTGATTCTTTGATGATATTGTTCTTGTCAAAGCTGTAAACATACATTTA

ACAATACTTTTTTCCCCATTTATAAAATAAGTTACCTAAATTATTACCATGTTCATTCAAAATAATTTATTGGGTTAA

GCATTTATGTTTATCTTCAAAAAAACTGTGGTACATGCTCTTATCTTATGTTTAGGAGATAGTATATAAATTGTTAAA

TAGTTCACTAAATTTAAATTTAAATAGTTCACTCTACCTAATTAGTCAGATGTATTGTAGTACTGTTAACATTAAATT

GTCTTAGAGTACATAATAAATAAAAAAGACAACAATTACATGATCATTTTCTGTCTTAGTTTCTTTCACAAAATTCGT

TGGCCTTTTTAATTTTTCTTTTTAAAAAAAGACATTCTAAGATGGAGAAAACCATCTTAGAAAGTCTACCTTTTAAGA

CGGTTTTTTAGGAAATCATCTTAGAATCCTCAATTTTTTTTATTTAAAAAAGACATTTCTAAGACGGTTTTCCCAAAA

ACTGTCTTAGAATCCTCATTTTTTTTAATTTTTTCTCAAAAAAAATAAAACATTCTAAGACGGTTTTCACGTAAAAAC

AATCTTAGAATCTTCAATTTTTTTTTTAAAAAAAAATACATTCTAAGACTGTTTTCACGTGAAAATTGTCTTAGAAAG

TTATGCTTCTAAGACGGTTAAGGAACCGTCATGGAAAGTGTTGACTTTTTATGACATTAACTTTAAAGAAGGTTCAA

AACCGTCGTTGTATGTCTCAAATAACTATCACCAAAGAGGCTTTTCTAGTAATGGAATAACAAATAGTCATATAAAA

ACAAACCACACCTCAATTGTGACTTCCCCAACACCAGAAAGGGTTTGGGCTCTTCAAACGAACAAATTGTAGCTTTC

ATCCACTCCAAGTTGAAGCTGCAACACAAGTTCCCAATCTCAAAATCAAAACTTCTTGAAAACCCATAAAAGGAAA

AACAAAAAAAAAACAAAATTTAAAAAGAAAAGAGCCCACCTCCTCACTGTATAAGTATATATTGGCCAATGGTAGA

TGTGGATTGGAGGATGATCGGTCTAAACCCGACCCATATAGCCGATTTAAGTCGGTTATTGGCCCAAGCAACAACAG

CCCCGTCTGTCCTGATCTGTAACGATGTCGTCTCATTCACTTCCTTAGCAAACAAGGTCATAAACCACCTTCGCAACT

CAAGCATACATGTGCAGCATGGTCTCTCTGACGTGGAGTTTACACGTGTCCAGGCCGAGTTTGGGTTCATGTTCCCG

TTGAACCTCCATGTTGTCCTAACCGCCAGTCTTCCCATCGGTTCGCGATTCCATGACTGACACTTTGGTGGCGCGCGA

CTGCACCTTTCTGCGTTGTTGGACCTTCTGATCGCGGTGATTTTGTTCTAGATCGTGAAAAATGTGTTGTGGTCGAAG

TCGTGGGGTCCACGGACGTGCAAGCCGGAGAAGGTGTTCTGAGTGGTGTAAAACACATTGAAGAGTGCTGCTACTG

ATTCCAATCTTCAACCATTGCTACATTTCTTCCAATCCCTCAGTCGCTGGAAACCCTAAAAAAATTGAATTGTATGGG

TTATTGTGACAAAATCAAAGAAGAGGGGGAGTTGGAGAGTGAGAGGGACATTGAGAAAAGACTAGAGGGAGAGAC

ATTAAAAACACACTCACTTCTAAGATGGTTTTTACAAAATCATCTTAGAATGAAAACCTTTTAAGATGATTTTTGCGA

AACCATCGTGGAATGATAGTTTTCAAAACTGTCTTTGTTGAAAAACCTCATATTTACAAAATTTTCACTTTCTGACTT

TCTAAGACGGTTTTTGGGGACCTTCGTCAAAGGTGCATCATAAAAAACTATTTTTTTAGTAGTGCCTTTTTTTTCGCT

GATATCTTTGTCATTCATTATATATGGTCTTGATGGTGGTGACATTTTTTTTTATCTTGATCTTTGTTGTCAACAAAAG

TTTTTTCTTCACTGCTTAAATGACTAACCTATGCATGTTCGACCAATGTTTCACTAACTTTCTGGTTATGAACACCAC

AGACAACAAAATGTTTCCAACCAACTTGTTTGACAAACTTCCCTTTTAATTTAAATGAACAACCACATTTTTTTTGTTC

TAGTACTCTTGCAAACTAACTTATCCTTATCTTGCTTGTACTTTCCTTCATTTTCACTACCCACTACAACATAAATTTT

CCTTCCATTTTCTGACCTATGAATGACAAGAATAAATCGAAGACTTTTCCACAAATCTCAAACCCAACCGAACAAAT

TGTATCAATTTTCAAAAACCTAAAAAATAAAATATTTTTCTTCACTTAAGCAACATACACATACATAAATATAAAAT

CAATCGACAACTAATCTACATATCTCATCAATTGTGAAATGATTGGAAAAGTTAGGGTAATCAGGTTAGGGAGAGGT

CAATGTCCAACCCATTGTCAGGATCTGTAGGCATTTTATCTGATTGATCTGCAAACATTTTATTTGATTGATCTGCAA

GCATTTCATTTGATAGATTGAGACAGTAAAAAACAATTTGACTATCATCATACATGTTTCCAAAACCCTAAGGCATT

GTAACTTCATCAGAAAAGATGTATTTCAATCCATGTATACACTGCAAAGAACCATTCATGAAAAATCAAAATTACAA

AAAATAACACATAATAGAATCATGATTTTGTTGTGTATTTGAAATTTGACACAAAACAAAATCAAGATTTCATTGTTT

ACTAAAATTTCAGATACTAAACTTTTATCATTAGCATTTTCAAATACAACAACTTTTTTATATATACAAAATAATTGT

-continued

ATATCAAATAATTTTATCCACATAAATTGCCGATTTAAAAATTATTAAAATACTTTTATTATCTAAACATATAATCTC

GTTATGTGTACATAATAAATGTATGATAAAATCTTCATATGTAACAACAATCTAATTAAGATAATCTCCTATTTGAAA

AATAATTTCTTCACATATCAAATTTTAACTTTTTATATATAAAAATAAATAAATAATTTTTTTTATTGATTTGTTTCTTT

GTACTGTAAGTAGTTATTTTGTTTTTAGTATTGGGTCGGGTCCAATGATGAGTGGTGAACTCCCTTGATTAAGTGCAG

CATTCCTTGACGGGCAAGAAACAGTATAAAAGGGTCTGCATGATTTTGATGTTTTGATCTCTCTCCAACCCTAACAC

CAACTTTTTTAATTAATTTTGTTGTTGTGAATTCCATGGAAGCCTCCGAAGACCAAACAGATATCATGGAGCCGCATC

TTGATTATTATACCCTGGAAGAAGATTTCTCAACAAGTTTATTTGAACTTGATGTTTTTCCACATCCTAAAGATCCCT

AAGAATCTCACATAACTTTCTCCGAACTTGTTGATTTTCTCAACTCCGCCTCCAATCGTCAAGAGGGTTCTCCTCACC

ATCACTAAATAAGTCCAAAATGGTACTGTTTTCGTCGACTAATAATGCCTTTTGTTTAAATATTTTGTGCTCTTGCA

GGATTTCACATTTTGTTTATCACGGGTTCTTACATGGATACTATGGTGAGCAACTACGGTGTTGTCCTTGCTCTAGTG

AAGCATCTTTGGGCGCTGCCACACACTACTACAAAAAATAGCTTTTACATCGGTTGATTTGGGCATTCTACGATGAT

TTTTAATTATTATCTTAGAAAGTCTTCACTTTTTACGACGGTTCCACAGAAAATCATCTTAAAAAATATCATTCTAAG

ACGGTTTTTAGCTAAAAACCGTCTTAGAATGGTATATTGTCTTAGAATGTATTTTTTTTAAAAAAATGAAATATATTG

AGGATTCTAAGACGGTTTTTTTCAAAAAAAAAAATCATCTTAGAATGTCTCTACATTCTAAGACGGTTCTCTTAAAAA

CTGTCTTAGAATGTATTTTTTGTTTAAAAAAATATTTTAAGGATTCTAAGACAGTTATTTAGAGAATTATCTTAGAAT

GTGTTTCTTTTTTTAAAAAAAAAAAATCTAAAATTTCATACATTTTTTACCATCAATCTTAGATTTCTATTCTAACCAC

ATGTTATTTCATATACTTTGCATGCTAATAGATACGGAAAAAAAAGGAAAAAAAAAGGAACAAAAAATATTGTCCC

CTAAAACAAGCATAATAGGAAGTCTTAAACAATGTAGTTATAATTATGTATGCATGTTATCTAATGAAATTGTATCA

AATATAAATAAGCAAGGTAGAAGTTATAATTTGTAATTTCCTTCTAGGTGGAACTTCACTCACGTGCACTAAAAGTG

ATTAGAAATAGTTTTTGTTTTGAGTTAAAAAATTTATATTAATTTTTATAGCAATTTTTTTAGTTTAAAAGCATCTAAA

TATAAATTATTTTACTTGAAAATAAATTTTAATTAAAATCTATTTTACAAACACTCATCCAAACATAAAATATTATTA

GTAAAAAAATAAGATGTTCTTAGACGTAGTGTTGTATTATGTATGATTTTTAAATTACATAATTAATATAAAAATTAA

TAAATTTATCATGAAAACTTATTATAAAATAACTATATAATTATTTTATATTATTAATGTGTTAACTATTTTACCTTCA

TATTATTGTACTATCTTTCATTTAATATATTATGTGGTAAAAAATGTTAAATTGTATTTTATTCTTCTTTATTAGTTGAA

AATATAATTAAAAAATAATATACAAATATCATTAATGTTGACTATTATTTGCATATATACCACTGCAAAGTTGGACA

AGACACACGACACACTATAATGCATGTGTATCATATTAATATACATGAATAGCTATTCACCTAATATATATTGACGC

GATGCATTACTACTAACTAGGTACCATATCAAGCAAGAGTTGACCTCTCTACGACCAGACCTCTATATAATTTTGTA

ACAATGTTTCCCTTTCCTACACTCCAAGCGAAACTTTGGATTCCATCAGTTTTAAGGAATCAGGTATCTTAGTCCGAA

GCTCAAGTATCAAAATACTTAAATCTATTTAAGGAATTAATTTCTTTCGATATATATTTTTGATTTAAATACATTTTTC

ATTCTTGCAATTTAACTTTTTTTTATTTTTGTTCTTGTAATTTTCTTTTCGTTTTACTGTGTTGCATAATAGATACAATA

CCAGAATATGTGATTATGCAACTACATTGTAAGTATGAGCAACTAAAGGCGTACCCGTTGTGCAGGGTTTAATCTCA

TCTTGACTTAGGCATATAGGTTTCGTAGGACCTGCTTCATCTCCACCTGGTAATAAAATCCAGCTATAAATAAGAGA

AGGAAGGACACAACAGTTATGTGATATATAGATATGGAATGCAATATCCTAAGGATGATATTCGTTCATATTGGGTC

ATAGACATACTCCTTATTAATGGCACGCTCAATGCATTGTTGTCTTCAAACCATCTGTGTAACTGGTCGTTTGCCTTC

ATAAAAAATCAAGACCAATATCTAGATCAAAAGAAAATCTAAATTTTTCAACTATTAAAAATAATTTAGAAACTAGC

TAAGAAAAATTTACTTTTAATTCAACAAAACTAGCTTATCACTTTTTAGTTACTAGCTAAGTTTTTAACTTTCAACTA

AATTTTAAACTTTTAGTTACTTTTACCCAAAATAATCATATAATATAAACTAATGTCAATTTCCATATAATTCAATGA

TGGTTGGTTTTCTTAATTAAATGTGAAGTTTATATTTGCCTATTCTATAAATCAAGTAGCAATGGAAATAACCATAAT

GAATGTCAACCTAGCACAAAGAAAATCAAGACAGAAGGGAAATTATATCAAACATAAGATGCACTCCCCCTCCCGG

TATTACAGGCATGAGAAAGTGAAGAAGAATTATTTAGTAAATTGGTAGAAAAACTAAAACAAAAAAAAATATTTGA

-continued

AGGCTTTAGAGTTGTGTCGTGAACAAAAGGAAGTTGCTAAGTGAAGGACTTACTTTAAAGAGTAAAGTGATGAGTTA

TTTGATTGAAAAAATCAATTGTCAGATCATGATTAAATGCATACAAATGTTTAATAAAATATGTAGCTATTTAAATCT

CTCAAGTCTCAACCTTTGATTTTCTAATCAATGGGTATAACTTTCACTTTAGTCTCTAAAGGAGTAAAATCAGAACAA

GGCAATCTGGGTTGGACCCACAGAATTTGAGATGAGCAAGGGGAAGAGGAAAAACTAGCATCATTGATCTGAACAA

GGGAGAGGTGGCACGTTAGCTATAAACAAAAATTGTAGCAACAAGAGACGAGATGCTCAGGGAATGACAACTCTTT

CTCATGATCTAAATTATCCCAAATCATTTTGTCTTTCCATTGCATAGTCCATTTTATTTCACATACCTCTCTATTTTCTT

CCTATTTTTATCCTTGTTCAAAGGATGTTGTGATAAATTAACGTTAATATATAATTACTCTACTTCAAAAACATAAAA

AAAAAGAGTGTAAATCGCACATTCCTGAACAGACATGTTGCACCACTTTATTTTCAAAAAAGAAAAGAAAAGAGAG

TAGCCAAAAACAAGAAAGAATGACATGCAATGGTAGCATAATTAATTAGCAGCTATGGAAATCCCTCTTTAAGCAC

TTAATTTTGCTAGCTTAAATTATACGTTAGAGAATCAACCAAAAAAAAACTCGCCTTAGGAACACCAACATACAGAT

CTTCTCCCTCTGGGTGGTTGATGATGACTCCATGTCTAGGATTCAACTCGTTGGTAGCTATGTCATTGTACATAAACA

CCACTATGTTCTCTTCTTTTAGTCCACCTTTTATCAGCAACTAGTATGCATGGCACACATCTGCTTGTTTATAATTTAA

TTCAATTCATCACAACATCCATAAACAAAACCATTAATGAAAAACACATAGCAACTCAAAACATAAAACTAATTAA

TTAATTTTAGAAAATAAATAAAAGGAGACACCTTGGTCTTTAAACCAATCCAAAAAAATAAAAACACCAAAACCAA

ATTAACTTACTTGATGCCTGTAGTTTCCATAGCCGTTTGAACTAGCCATGAGAACCGCCCATCGTGTTCCCACTTCAT

CCGAGTCAGCATCCACCGGTTCAGTCGGTAACTTTATGACTGAGTCCCACTCCTTACGGTTCAGCCTCGCGGCTGCA

CCGTGCACTCTCACGAGCACCACCATCATCCATAATAGGACATTGTACCACGTCGTTTTGCTTATAATGGAGCGATG

AAGCGCCATATATATCAGCTGAGAAAAACAAATGTGACACCCTCTACCCTCACAAATAACGAATAAAAGGAAATAA

AATCATGCGGATTTTTTTTTAAACACATTGACTTTAAATTGATTTCAAAAGATAAAGGGTTCACATTCACTTAATGAA

AACATAGTAGAAATTGTTCGAATAAAAACAACAAAGTTATCCCGGCTCAAAACAAGGTCGTCCATGCTGAATGAAT

AATAATAATAAAAAAACTAAAACAGAAAACATAACACAACTATATCGTTTACGGAAAATATAACATGCGAAGTAAA

ATCCTATGCCCCAATGTCACACTTATCAGAGCATGTCTCTATCACAGACTAAGTCTCTCCGGCTCTAACATGGAATTT

ATCATGTGATGGCTCACCTGAACAAATGACAATCAGCCCAAACACAAACACACACTAGGAATGAGTTATCACATTC

ATATATAATAAAATATTAGAGCATGTAAAACATATAATACTTAAAGCTGAATTTATATAATTAACATCACTTCCCAA

AATCACACACATTTTGCACATCCATTCAAGTTCATCCACTCCAGAAAATAACATCAAACCACAATTGTTAACTCAAT

GAAAGTCAAACACATGCATTATGCAACAAATACTCTAGACTTAAGCCTACATGCAATGTGGTACCATTTTTCAGTGA

AAAACCTCGTTGGGCGCCTAAGAGTACATGACAGGACATGCCTCACAATGGGTAAGTTAGGTCACTTTCACTAAGTG

AAATCATAGGGAGACCAGTCAGGATCACGTTGTTTTGCGAGAATGCTCCAACCATGTGGGAGCGGCACAGGCTTAA

AGGAGCACTCAAATCGGATGACCCCCAAGGCCTACACTCCGAAGAGTTCGTCAGGGCCTCTCCCTCCTGATTCAGGT

CTAACCCAAAAAAAAATTTGAACACATAGACTCTACCTATGAATTATGCAATGCACACAACTACTCAATTGTGTGTG

TGTGTATATATATATATATATATATATATATATATATATATGTATGTATGTATATTTTTAAAATATATTTTAACTCAGT

GCACCTCAAGTGATTAAACTCGTCGGGTTCCCACAGTGGATCTCATCACAACTCTTTGCGCATTAACTCGTCGCCCTT

AAAGGGTCTTACAGTTGTGTGATTACATAATTCATGGCTCACAACTCAAAACATAGAACATCTCAACAATTATGTAA

TTCACAATCCATTATGTACTAAATGATTATCACTTACACACAGTCTCAACCACAATTTCATAATAAAATAATTTATCG

CATCTCACGCATCCTACACATATCATTCAATAGTAACATTTACTTGACACAATAAAAATATAGATTAACCGAATATA

TTAATTCAACAAAATAAATAAATAAAAATATCTACAACAATTAATTTGAGATGTGGCAAAAATAATTATGATTAAGC

AATAATTTTACAAAAGTATTTAATTTATTATTATACATATATAACTAAAAAAATAAAAAAATAATAATGTCACAAAA

TATTTAATTTATTTCTCCAGAGCAGTAAAATAATACATTCACAACAACATTTAATTTATTATATATATATATATATAT

ATTAAAAGCAAAAACCATGTGTTACAAGTATAATATCTTTAATGATAAACGTATTAAATATATTATTACTGCACCTTG

AAGGGAATATTTAACGGCTGAAATTCATTTATAAGAAATATTAACGTATGCATTTTTTTCCACCTTAAAAAGAATGTT

-continued

TATGTTGTAATTTGTTGATCAATTTAATATGTAGAAAACAGTAACATATCAAGCATATTTGTTGCGCCCTAACGTATC

AAAGTTTTCTGTTGTAATTTTGTTAGACTATCAAATTAGTTTGTTAACAAATTTGTCAAGAAAAATTAAAAATTTGAA

ATTAAAAGGTGCAGTCAAACCATTAATTTAACAAACATATTTTTGAGACTACAAATATTTTATACTAAAATCAATCC

CTAGTCAAGTCAAATAGGACAACTATAAACAATGTATAACTAATTTGTTGGTTTGCATTTTTTTTTTTTGTTCTTTTTT

TCAACAAGTATTACATACACGTCTTACACTATTTTCAAAAGAGTTGTGGCAAATTTAAAGCAACGATTCCCAAACAG

GGAAAACAACTCTTATTTCAATTGAAAACTTCCAAATATAATAGTAGGGAAAAAGATGACAATAAATTGTAGTTCAT

TACAAACAATAGACAATACAATTATTTGGGTCAAATTTTTCATTCCAATGATAACAATTCACTAACACATTCAAAAA

ATAAAAATAAATCACAAGCGCAAAACAACGAAAATCATACACGTTAATATACAACAAGAAATCAAGTAATAACAAT

TGAAAATTAAAAAAATCTAATATACACCAAGAAAATATCATATCAATATATACTAACAGGATCATAGAATTTCATAA

CAATAGATATTACACTCAATTTAGCGTAAGAATTATTCAATTTGAAAGAATCATGAATTAACATTTTATAAAAACAA

CCCAAAATACCCCAAAATTGATCCTCTAGAAATCCTTATACATGTTCTTCTAATCCTCAAGCGTGAGTAACTCATCC

CTTACCTCGATGTAGTCGCTCAAACGTTCTCCATTAGCAATTGTGGCATCTCTGGTGCTCTCTAGAGCTCCTCATCTG

GTTGTTCTGATAGGGTTCTTGTGCGTCAGAAAAAGAAGAAAGAAATAGAAGTGTTTTATAAAAGCTGCTCTAGGTTA

ACATTTGGTTTATATAGTGGAAAATTATGACCTAATTACTTTTACTTATTTATTTACTAATTTATTAATTTTATTTTATA

GGAAAACTTAAAAAAAAAAAAAGCATGGTTGTTACAACAAACTCACTCAGTCACTCACACACACAGGAGTAGGTGTT

GGGTTGACAAAGCAGAGGAGTGAAGAAAGGGTTTATTAATCAAAATTGACTCACTTTAAAGACAATATGTCATGCAA

ATTTAGAGCGCGACACATTCAAAATCAAAACAGTTTGGGAAAAATGATGACAAATTCAAAACCATTTCTTAAAATGA

ACTTTTATACTATGAATAAATTAATCAAAAACAATACTTTCCAACTAAACAATGACTTATTGTCATTTCTCTACAGCT

TCCAAGAGATGAAAAAAGAACCACGACAGAAGAAACAAATTAGGGATGTTAGTTACCAGAGAGCTGAGTGGTTAGA

TCTACTAGAAAAGATTTAACACCCTTATCTTCCGTTAGCAACATGGGGAGGCCATATTTCTTAACTTTCACAAAGCTT

TCTTCTGGATAAACTCCACGGTTGTAGAGATTGTTGATCAAATTCCCATATTAAAATAAGGCCCAAAATAAATTAAA

AAATGCAGGATACAAGGATCAAACTTGATGGCAGCATATCCTAATTTGAAAAAATCACCAAAAAAAAGATCAGGCA

AAAGTTCACAAAAAAATACACAGGTATGCAAAAATCAAAGAAATCGGAGGAAAGCGAGAAAAGAGAAAAATGATAT

GAATACCGAAGAACTCACTAACGATTGTTGCGGAACCGCAAATAGTGATTATGTCTTTGGCAACTGTTCTTGCGGCC

ATGTCTTTTCTTTGGAGTCTAATTTTGAGCAACGAACGTTTAAGTTTTGGACATAGGGTTGGGTGGAGCTTGTTCGCA

CGATGAAGCAAAATGGGAAAGCTTTTGTTTCGATTGTGGGAACACTGGTAAGCGAAATGAACTGGTTTTGAAAAGG

GGAAAATAATGGCACTTAATTAGGGATTGGAAGTGGAAAGAATAAAACTTGATAGAGAAGCACCATATCCACTAAA

AAAGGGGTATCGATGTTGTAAGAAGTTGGTGGGTCTTTCTACAAGTCCTTGAGCTCCTTGAGGATGCGCTTTGAAGC

CATGGGAGGGACGATACGCATTCAGATCTGAAAGGGAAAGAGGGATCTGGATATCAGGTTTTGGTTGTGCAGCACC

AAAAACCACAATCAGTGAAAGAGGGATTTGAAAGGGAAAGAGGGAAAGAGTGAGAGTGAGAGGTCTCTGTGGCTC

TCGCTTATGGAGAGTGAAAGAGCGAGTGAGGGAGAGCAAATGTTTAAGCTCTCAAGAGGGAGATATAAAAATTAAA

AACATATTCTCTTCGAAGACGGTTTTTTAAGACGGTTTTTGCAAAACCGTTGTGGAAGGGTAGTTTCTAAGATCCCAT

ATTTACAAAATTGTCATTGCGTTACATACTAAGATGGTTCCTTCTTGAGGAACCGTCATCGTTTTACTATCGTAAAAA

ATGCTTTTTCGAGTAGTGACAGACCATTGAGAAGCATGAGGTGGAGAACAAATATGCACACATCCTTGTAATTCTTG

CTATTAAAGTAATTAAGTTCTACTCATCCTTTTCTCCCTAAATATCTTAGTTAATGCTATATATTATATTGTCATTATT

GAATATATAAGGGGACGAATGCATTGAAATTGCTCTTGAATGTACTATTTCTCTCACAGGACTCATCCCTAAAAGGG

ATTCAAAATTATAGTGTAATAGATTATATATTAATTTAGTTTACTTTTATAACTAAATTAAAATTATTATCTTATT

TTATGTTCATTTTCTTCAAATTAAGATGTGAGGTGTGACTTAAAAAATATTATTATGTTAGTTTTTAGTTTCTTTTTTAT

TTATTATCTTTGTAAGGGCATACTGAATGAATTTTTAGCTCACTCTACAACATATCAATGTGTAATTGATATATGATC

ATAAACTTAAAATATTTATTTTTTAACAAAATAAGAAACAACTAAAAATTCAAATTATAAATGAAAAAACTAAGCAT

-continued

```
TAGTATATTAATAATGAACAAAAATATGAAATATTTAATATGAAATGATATCTTGTTGATGATAAAAAATAATGACC

TAACAGAATACTTTCTTTGATAGACAGAACATAAAATTAAATTGTTATAAATATATAAGTAAATTAAAGTTATAAAG

GATGTGATGAGTTTCTTATAGCTTTATTCGAAGTTATAAAACTCAACCGGAATGGAGATAGATTTAAAAAATATAAA

TCAACCTTTTTAAATGTTGGGGATAGTTAATTTATCATCGACTCATCCCATTGTCATGTTTATAAATATTTATGTTATG

TAATTATTTTATGAATAAATTAAATGATAGATGATAATATAAGAGTAAATTGAATAAAAACATGCAATATATATATA

TATATATATATATATATATATATATATATATATATATATATATATATATATATATATATATATATGAGTCTCATTAAAC

CTATGTTATTTGTATAATGTAAAAAAATGTATATTTATAATCAAACTATGTATCCACTTTTTATATATAATATATCTTT

ATATTTTCAAATACTTATATATAAAAGGGTACATATTATTTTTTTTGTTATCGGCCCATGAAATCTTGTGTGCATCCAA

TAACATGACTAGCACACATTAATTAATTAAATGAAAAAGTGAGATGGAGAGTCTTGATAATTTTAAGGGTGATGTTT

GAATAAATAATAATACACATTACTCTCCAAATTAACATATAAGTGAAGAATATGGGTGTGTTGGATTAAATACATCA

ACCATACTGCGTGCATGNTACGTCTCTATGTGTTTTCTATTTGAGTGTTCAGTAGTATATAATAGTGCGGCCCTCTTTT

ATAAGAAAAGATTATGGGTGTCTNTGAATCTCTGGTACGAGGGTCCAAAAATTGTTTAAGAATAAAATAGTTTNCAA

GCCCGTGTGTTTAC
```

Example 5

Summary

Majority of the disease resistance genes contain NB-ARC and LRR domains. N-termini of these genes carry either a coiled coil (CC) or a TIR domain conserved in Drosphila Toll and mammalian interleukin-1 receptors. Soybean Rps1-k-2 encoding *Phytophthora* resistance is a CC-NB-ARC-LRR type resistance gene. By conducting transient co-expression of reporter genes GUS, GFP and DsRed2 we have shown that over-expression of Rps1-k-2 significantly inhibit the expression of all three reporter genes. Site-directed mutagenesis experiments showed that the Rps1-k-2-mediated inhibition of reporter genes is abolished among five of the 14 mutants containing single amino acid substitutions. We have shown that both NB and ARC motifs are essential for Rps1-k-2-mediated suppression of reporter gene expression. Surprisingly, mutants were able to co-express reporter genes in significantly higher number of transformed cells than the internal vector controls. Co-transformation of individual mutants with Rps1-k-2 abolished the Rps1-k-2-mediated suppression of reporter gene expression. We conclude from these data that over-expression of Rps1-k-2 initiates a cell death pathway, for which NB and ARC motifs are essential. Results obtained in this investigation also suggest that mutants either directly interact with Rps1-k-2 or compete with Rps1-k-2 for factors necessary for the cell death pathway. Mutant rps1-k proteins also possibly compete for common factors essential for the wound-induced cell death pathway.

Introduction

An array of resistance (R) genes provides plants with protections against invading pathogens, including viruses, bacteria, fungi, nematodes and insects (Dangl and Jones, 2001). These genes however confer race-specific resistance and require the corresponding avirulence (Avr) genes in the pathogen. Upon a successful recognition, mediated directly or indirectly by avirulence (Avr) and R-gene products, a range of active defenses including rapid and localized cell death, also know as hypersensitive response (HR) are initiated at the infection site. The HR is often associated with a transient burst of reactive oxygen species, ion flux, and cell wall modification, accumulation of phytoalexins and activation of defense-related genes (Hammond-Kosack and Jones, 1996).

R genes that require pathogen effector proteins for their activation are grouped into five classes (Martin et al., 2003). The most prevalent class of R genes has a central NBS, domain with nucleotide binding site and a carboxy-terminal LRR domain (Ellis et al., 2000; Young, 2000). Based on the sequence similarities at the N-termini this NBS-LRR class is further divided into two groups: (i) N-termini of one group has homology to the cytoplasmic domains of the Drosphila Toll and mammalian interleukin-1 receptors (TIR-NBS-LRR); whereas, (ii) the N-termini of the other group has the potentiality to form coiled-coil structure (CC-NBS-LRR) (Pan et al., 2000). The NBS domain comprised of two sub-domains. N-terminal sub-domain NB contains kinase 1a (P-loop), kinase 2 and kinase 3a motifs (Traut, 1994); whereas, C-terminal sub-domain ARC (Apaf-1, apoptosis protease activating factor-1, R gene products and CED-4) is conserved in most plant and animal NBS-containing proteins. These motifs are commonly found in ATPase, elongation factors and G-proteins from both prokaryotes and eukaryotes that have vital functions in cell growth, cell death and defense (Aravind and Koonin, 1999; Van der Biezen and Jones, 1998).

N-termini of R gene products have been found to influence the downstream signaling (Feys and Parker, 2000). Whereas, LRR domain of the C-terminus is involved in recognition (Dodds et al., 2001; Ellis et al., 1999; Meyers et al., 1998; Noel et al., 1999). Mutational analyses also however revealed that the LRR domain plays an important role in downstream signaling (Warren et al., 1998).

Apoptosis protease activating factor-1 (Apapf1), the mammalian homologue of the nematode *Caenorhabditis elegans* CED-4, mediates caspase-9 activation and apoptosis (Hickman and Helin, 2002). Self association of Apapf1 and recruitment of procaspase-9 requires dATP/ATP hydrolysis and cytochrome c binding to Apapf1 (Hu et al., 1999). The structural relationship linking Apaf-1 and plant NBS-LRR R genes imply that NBS-LRR proteins may function as ATPase and bind ATP. Tomato 1-2 and Mi-1 proteins are shown to be functional ATP binding proteins with ATPase activity (Tameling et al., 2002). Partial or complete loss of R gene function can occur by single conserved amino acid change within the NBS domain (Axtell et al., 2001; Dinesh-Kumar and Baker, 2000; Tao et al., 2000). On the contrary, point mutations in the conserved motifs of the NBS domain resulted in gain-of-function cell death phenotype (Bendahmane et al., 2002). NBS domain plays a fundamental role in hypersensitive response development. Large-scale mutation analyses of the *Arabidopsis* RPM1 disease resistance gene revealed that missense mutations were highly concentrated at the NBS domain. This suggests a critical role of this domain associated with the RPM1 activation or in the RPM1 stability (Tornero et al., 2002).

There are five functional alleles including Rps1-k at the Rps1 locus. They confer resistance against the oomycete pathogen *Phytophthora sojae* races (Schmitthenner et al., 1994). Fourteen Rps genes have been shown to confer race-specific resistance in soybean (Anderson and Buzzell, 1992; Burnham et al., 2003; Polzin et al., 1994; Schmitthenner, 1989). More than fifty races of *P. sojae* have been reported and new races are rapidly evolving (Leitz et al., 2000). A multigene family of CC-NBS-LRR type resistance genes has been recently isolated from the Rps1 locus by applying a positional cloning strategy (Gao, unpublished). Of this family, Rps1-k-2 conferring race-specific *Phytophthora* resistance was fused to the cauliflower mosaic virus 35S promoter and attempted to develop stable transgenic soybean plants. Transgenic soybean plants were successfully developed from the native Rps1-k-2 gene. Whereas, the 35S:Rps1-k-2 fusion gene caused necrosis in cotyledonary explants during *Agrobacterium*-mediated transformation process and failed to develop transgenic plants that express *Phytophthora* resistance (Narayanan, unpublished) (Zhang et al., 1999). We have shown by with the aid of reporter genes α-glucuronidase (uid A) gene (GUS), GFP or DsRed2 that over-expression of Rps1-k-2 initiates a putative cell death pathway in etiolated soybean hypocotyls (Chalfie et al., 1994; Goodin et al., 2002; Haseloff et al., 1997). Here we report the role of NB and ARC motifs in cell death pathway initiated from the overexpression of Rps1-k-2 in etiolated hypocotyls.

Results

Transient Co-Expression of Rps1-k and GUS

The plasmid containing Rps1-k-2 fused to the cauliflower mosaic virus 35S promoter (35S:Rps1-k-2) or an empty vector was transiently co-expressed with the reporter gene uidA (GUS) encoding α-glucuronidase in etiolated soybean hypocotyls (FIG. 16*a*). The level of GUS expression is presented as the average number of blue spots resulted in from successful transient expression of GUS. Average number of blue spots was significantly lower in hypocotyls co-bombarded with the 35S:Rps1-k-2 fusion gene than that in hypocotyls with vector control (FIG. 16*b*; Supplementary Table 1). Significant reduction of GUS-positive cells among hypocotyls bombarded with the 35S:Rps1-k-2 fusion gene suggests that over-expression of Rps1-k-2 inhibits the co-expression of GUS activities. At high concentrations, the Rps1-k-2 protein become presumably functional to cause cell death; and therefore, fewer cells showed GUS expression as compared to that in the vector control.

Transient Co-Expression of Rps1-k and GFP or DsRed2 Proteins

Use of the GUS reporter gene in transient co-expression experiments suggested that over-expression of the Rps1-k-2 protein resulted in the activation of a cell death pathway. A 2-reporter based reciprocal transient expression system was applied to support the observation presented in FIG. 16. In this system we co-expressed 35S:Rps1-k-2 with either green (GFP) or red fluorescence protein (DsRed2) as follows. Gold particles were coated with either (i) empty vector and the 35S promoter fused GFP (35S:GFP), (ii) empty vector and the 35S promoter fused DsRed2 (35S:DsRed2), (iii) 35S:Rps1-k-2 and 35S:GFP, or (iv) 35S:Rps1-k-2 and 35S:DsRed2. Gold particles containing empty vector and 35S:GFP were co-bombarded with gold particles containing 35S:Rps1-k-2 and 35S:DsRed2. In the reverse experiment gold particles containing empty vector and 35S:DsRed2 were co-bombarded with gold particles containing 35S:Rps1-k-2 and 35S:GFP. In the negative control, gold particles containing empty vector and 35S:GFP were co-bombarded with gold particles containing empty vector and 35S:DsRed2. When gold particles carrying empty vector and 35S:GFP were co-bombarded with gold particles containing empty vector and 35S:DsRed2 about equal number of GFP or DsRed2 positive cells were observed. About 40% of the transformed cells showed both GFP and DsRed2 expression (FIG. 17).

Transient co-expression data of Rps1-k-2 with either GFP or DsRed2 proteins in etiolated hypocotyls are presented in FIG. 18. The number of cells expressing GFP from co-transformation of both 35S:GFP and Rps1-k-2 was expressed as a ratio over the number of cells expressing DsRed2 from co-transformation of 35S:DsRed2 and the empty vector in the same hypocotyls tissues. Similarly, relative levels of DsRed2 expression from co-transformation of 35S:DsRed2 and 35S:Rps1-k-2 over GFP expression from co-transformation of 35S:GFP and the empty vector was calculated from individual hypocotyls. These two reciprocal transient co-expression experiments produced comparable results. Most importantly, co-bombardment of two kinds of gold particles, one containing a reporter gene and the empty vector to serve as an internal control, allowed us to determine the effect of Rps1-k-2 on the co-expression of the reporter fluorescence proteins. Co-expression of two reporter genes, one with Rps1-k-2 and the other with the empty vector, on the same tissue also allowed us to investigate if Rps1-k-2-induced inhibition of reporter gene expression was due to initiation of a putative cell death pathway. As compared to the number of GFP or DsRed2 positive cells in the internal controls, the number cells expressing either of the reporter genes were much lower when Rps1-k-2 was co-transformed (FIG. 18). The data obtained from these experiments support the results previously obtained from by using the GUS reporter gene (FIG. 16 and FIG. 18*d*).

Identification of Amino Acids Essential for the Rps1-k-2 Mediated Inhibition of Reporter Gene Expression Two independent co-expression studies revealed that Rps1-k-2 significantly inhibits co-expression of reporter genes (FIG. 8). Most likely overexpression of Rps1-k-2 induces cell death pathway, and thereby, reduces the number of cells expressing the reporter genes. At higher concentration the Rps1-k-2 protein undergoes conformational change to become active and initiate the cell death pathway. The NB-ARC domain is most likely the most important interacting domain involved in initiating the cell death pathway. To test this hypothesis and identify the essential amino acids necessary for this signal pathway we conducted a site-directed mutagenesis experiments. Fourteen amino acids highly conserved among resistance genes were selected based on their (i) conservation across the NBS-type R genes or (ii) importance in the expression of disease resistance (FIG. 15B and Table 1; Bendahmane et al., 2002; Dinesh-Kumar et al., 2000; Axtell et al., 2001; Pan et al. 2000; Tao, et al. 2000; Tornero et al. 2002). A PCR approach was applied in creating these mutations (see materials and methods). We conducted reciprocal transient co-expression experiments using GFP and DsRed2 reporter genes for investigating role of 14 selected amino acids on the putative cell death function encoded by Rps1-k-2. PCR-based site directed mutagenesis was conducted to develop mutants with substituted amino acids for the selected residues. Five mutants failed to inhibit the co-expression of reporter genes (FIG. 19). Surprisingly, in presence of any of the five mutants the level of reporter gene expression enhanced more than two folds than that in the empty vector control.

To eliminate the possibility of PCR-induced random mutation leading to early stop codons or frame-shifts for loss of cell death function among these five mutants, each mutant was re-mutagenized back to its wild type amino acid by applying the same PCR-based site-directed mutagenesis approach used in creating these mutants (Table 2). Results from reciprocal transient co-expression analyses of the corresponding mutants and their revertants are presented in FIG. 20A. Each of the mutants was successfully reverted to the original wild type phenotype. The other nine mutants, failed to interrupt the putative cell death pathway induced by over-expressed Rps1-k-2 protein, were confirmed by sequencing. Of the five mutants three contain mutations in the NB and two in ARC motif (FIG. 20B).

Induction of Putative Cell Death Pathway is Abolished when Rps1-k-2 is Co-Expressed with the Mutants Enhance level of reporter gene expression when co-transformed with individual mutants as compared to that of the internal control with the empty vector led us to investigate if any of the mutants can inhibit the Rps1-k-2-mediated putative cell death pathway. Reciprocal transient co-expression experiments were conducted for Rps1-k-2 in presence of any of the five rps1-k-2 mutants. In these experiments corresponding mutants were used as the internal controls. Identical results were obtained in reciprocal experiments. Each of the mutants was able to abolish the Rps1-k-2-mediated inhibition of reporter gene expression, when both Rps1-k-2 and individual mutants were co-transformed (FIG. 21). These results indicate that mutant rps1-k-2 proteins either directly interact with Rps1-k-2 or compete with the wild type Rps1-k-2 protein for factors required in initiating the putative cell death pathway.

Discussion

Transient Expression Systems

Rps1-k-2 was fused to the cauliflower mosaic virus 35S promoter and transiently co-expressed along with the reporter gene β-glucuronidase (uid A) gene (GUS) (Jefferson et al., 1987). Co-expression studies showed that the 35S:Rps1-k-2 significantly inhibited the GUS expression when compared with the vector control (FIG. 16). The results are consistent among a total of 13 replications from four independent experiments (Supplementary Table 1). Transient overexpression of 35S:Rps1-k-2 in soybean hypocotyls presumably causes conformational changes of Rps1-k-2 to its active form that initiates the programmed cell death process. Transient co-expression of GUS was carried out in cloning the *Arabidopsis* disease resistance gene RPS2 that confers resistance to bacterial pathogen *Pseudomonas syringae* carrying the avirulence gene avrRpt2. It was shown that transient complementation of a susceptible *Arabidopsis* rps2 mutant initiates hypersensitive cell death following infection with *P. syringae* and resulted in fewer GUS positive cells as compared to that in the vector control (Mindrinos et al., 1994). In our studies over-expression of Rps1-k-2 presumably resulted in cell death, and therefore, observed significantly reduced number of GUS-positive cells. Our observations are similar to that observed for human CARD12, a member of the CED4/Apaf-1 family, that induces apoptosis when expressed in Vero cells (Geddes et al., 2001).

GUS fusion protein expressed in transient assays is generally visualized in situ by histochemical staining and light microscopy (Restrepo et al., 1990; Varagona et al., 1992). One of the main drawbacks of using GUS as a reporter is that the assay is destructive and we cannot visualize gene expression in living plant cells (Mantis and Tague, 2000; Taylor, 1997). In the present investigation one problem faced with the GUS reporter gene was the inability to compare between the co-expressions of the reporter gene along with (i) Rps1-k-2 or (ii) the empty vector in the same bombarded tissues. This was achieved by using two fluorescence proteins GFP and DsRed2. GFP from the jellyfish *Aequorea victoria* and DsRed2, a newly discovered autofluorescent protein originally isolated from the non-bioluminescent coral *Discosoma* sp., are important reporters for monitoring gene expression in plants (Chalfie et al., 1994; Goodin et al., 2002; Haseloff et al., 1997). Unlike GUS, these proteins can be localized in live plant cells by illuminating with lights of appropriate wavelengths and detecting emitted fluorescence with the aid of a fluorescent microscope. Therefore, simultaneous expression studies for both reporter genes are feasible in the same tissue sample.

Our co-expression of GUS with the 35S:Rps1-k-2 fusion gene strongly suggested that the expression of the reporter gene is highly suppressed by the over-expression of Rps1-k-2 (FIG. 16). However, we compared co-expression of the reporter gene with either Rps1-k-2 or the empty vector in separate etiolated hypocotyls; and therefore, although the results are consistent between experiments experimental variations or possible experimental artifact cannot be completely ruled out from these studies. In GFP and DsRed2 system both reporters were co-bombarded in different gold particles along with either Rps1-k-2 or the empty vector to the same etiolated hypocotyls tissues. We observed that under our experimental conditions about 40% of the times individual cells were co-transformed by DNA molecules from both types of gold particles used in co-bombardment experiments. Therefore, reporter genes were expressed in independent cells in about 60% of the times. This allowed us to study the possible effect of over-expressed Rps1-k-2 on the expression of a reporter gene in the co-transformed cells by comparing the expression levels of a reporter co-transformed with an empty vector on the same tissue samples under identical experimental conditions (FIG. 18).

Experimental Procedures

Plant Materials

Etiolated seedlings of the cultivar Williams 82 (Rps1-k) were grown for eight days in Strong-lite medium vermiculite according to Ward et al. (1989).

Plasmid Construction pPadma45, a plasmid vector for transient expression and mutational analysis was constructed as follows. The double 35 S (2×35 S) promoter was excised from the binary vector pTF101.1, a relative of pTF 102 (Frame et al., 2002) by digestion with HincII and it was cloned into pBluescript ($KS^-$) to yield the plasmid pPadma37. The fragment carrying the tobacco etch virus 5'-nontranslated region (TEV-5'-NTR) (Restrepo et al., 1990) was obtained by amplifying pTF101.1 with two primers TEVEVP2R and TEVBP1 (TEVEVP2R: 5'CAA GTG GAT TGA TGT GAT ATC TCC AC 3' (SEQ ID NO:65); TEVBP1: 5'CGG GAT CCC GTT CGT AAA TGG TGA AAA TTT TCA G 3' (SEQ ID NO:66)). The PCR product containing TEV-5'-NTR sequence was amplified and digested with EcoRV and BamHI and then cloned into pPadma37 in the EcoRV and BamHI cloning sites that are located at the downstream of the 2×35S promoter. The resultant plasmid was named as pPamda 38. The Rps1-k-2 gene (99-6A; Gao, unpublished) was cloned into the BamH1 site of pPadma38 as a Bcl1 fragment and the resultant construct was named as Padma39 (Gao, unpublished). pPadma39 was digested with XbaI, and then end-filled using the Klenow fragment of the *E. coli* DNA polymerase I. The end-filled vector was subsequently digested with SpeI and the HincII and SpeI fragment containing the 35S 3'-end fragment from pISUAgron2 was cloned into this end-filled and SpeI digested pPadma39 vector. The resultant plasmid is called pPadma4o. In order to remove the original XhoI cloning site originating from the pBluescript II KS(+/−) vector, pPadma40 was digested with SalI and SstII and the SalI and SstII fragment containing the Rps1-k-2 gene was cloned into the XhoI and SstII sites of the pBluescript II KS(+/−) vector and the resultant plasmid was termed as pPadma45. This construct was used for PCR-based site-directed mutagenesis experiments. pPadma 41 without the resistance gene was constructed to use as the empty vector control.

pISUAgron2 was constructed as follows. The KpnI-PstI fragment containing 35S 3'-end fragment from pPTF102 (Frame et al., 2002) was cloned into the pUC19 vector and the resultant construct was named as pISUAgron1. The EcoRI-HindIII fragment containing the 35S 3'-end fragment from pISUAgron1 was cloned into pBluescript II KS(+/−) vector and the resultant plasmid was named as pISUAgron2. The HindIII fragment containing the GUS fragment from pTF102 (Frame et al., 2002) was cloned into pISUAgron2 in the correct orientation and the resultant plasmid was named as pISUAgron3.

pISUAgron6, a plasmid vector used in transient expression analysis was constructed as follows. pTF 101.1 was modified by inserting restriction sites NruI, StuI, NcoI, MluI in between BamHI and HindIII and the new plasmid vector is named as pTF101.1 m. The fragment carrying the 3'-end of the soybean VSP gene was PCR amplified from pTF 101.1 using primers VSPF and VSPF (VSPF: 5'-CGC GGA TCC TCT CAA CAA TCT AGC TAG AG-3' (SEQ ID NO:67); VSPR: 5'-CGA ATG AGC TCC CGG GAG GCC TAA GAC GTG CTC AAA TCA C-3' (SEQ ID NO:68)). The PCR product was digested with BamHI and SacI and cloned into Padma38 as a BamHI and SacI fragment and the resultant plasmid was named as pPadma43. The HincII and SacI fragment of Padma43 containing the soybean VSP 3'-end was then cloned into SmaI site of pTF101.1m and the resultant plasmid is termed pISUAgron5. The BclI fragment containing Rps1-k-2 used in the construction of pPadma39 was cloned into the BamHI site of pISUAgron 5 and the resultant plasmid is termed pISUAgron6.

PCR-Based Site-Directed Mutagenesis

Oligonucleotide-based site-directed mutagenesis was conducted to introduce specific mutations into Padma45 containing Rps-1-k-2. Two primers containing the desired mutation were designed for each target site for substituting amino acids (Table 1). The nucleotide change for each amino acid substitution was based on the standard genetic code and codon usage table for *Glycine max* (codon usage database: http://www.kazusa.orjp/codon/). Two unique restriction sites XhoI and HpaI were utilized in carrying out the PCR-based mutagenesis (Supplementary FIG. 1). XhoI is located within TEV leader and HpaI is at the LRR region but very close to the NB-ARC domain. Two primers, one complementary to the sequence containing the XhoI site (Pd45-XhoI, 5'-gagaggacctcgagaattaattc-3') and the other complementary to the HpaI site (Pd45-HpaI, 5'-gacgcaagttaacaagattgcgc-3') were synthesized and applied in conjunction with primer pairs for individual target sites containing essential candidate amino acids considered for substitution (Supplementary FIG. 1). The PCR reactions contained (10 mM Tris (pH 8.3), 50 mM KCl, 0.05%,7 mM $MgCl_2$, 1.25 mM dNTP, 5 pmoles of both primers, 200 ng of template and 0.5 U Taq DNA polymerase (Gibco-BRL) per 100 µl final volume). PCR was performed with initial denaturation at 94° C. for 2 min, followed by 10 cycles of 30 sec at 94° C., 30 s at 55° C., and 2 min at 72° C. These PCR products were run on 0.7% low melting agarose (SeaPlaque®, GTG®, BioWhitaker Molecular Applications, USA) gel and then eluted from the gel and extracted with phenol and chloroform, and precipitated with ethanol. Purified PCR products were then used as templates for the second PCR, in which Pd45-XhoI and Pd45-HpaI primers were used. The second PCR was conducted for 20 cycles (initial cycle at 94° C. for 2 min, then 20 cycles of 30 sec at 94° C., 30 sec at 50° C. and 2 min at 72° C. and final extension of 8 min at 72° C.). The PCR products were digested with XhoI and HpaI, and then gel purified and cloned into the XhoI and HpaI sites of the plasmid vector pPadma45. During this PCR cloning process the XhoI-HpaI fragment containing the wild type NB-ARC domain of pPadama45 was replaced with the PCR generated XhoI-HpaI fragment containing mutations in the target sites (Table 1). The PCR approach applied in generating mutants was also applied for developing the revertants (Table 2).

Transient GUS Expression in Etiolated Soybean Hypocotyls

Eight day old soybean hypocotyls were placed inside Petri plates (9 cm in diameter) containing moist filter papers. Hypocotyls were then bombarded with 5 µg circular plasmid DNA coated onto 500 µg gold particles using a PDS-10001He Biolistic Particle Delivery System (BioRad, Hercules, Calif.). Hypocotyls were bombarded at 1350 PSI Helium pressure with plasmid DNA-coated gold particles (Bio-Rad, Hercules, USA). Gold particles were coated with either (i) 5 µg of GUS plasmid and 5 µg of pISUAgron6 (Rps-1-k-2) or (ii) 5 µg of GUS plasmid and 5 µg of pISUAgron5 (Vector) according to Sanford et al. (1993). Bombarded hypocotyls were incubated at 20-22° C. for overnight in dark. Twenty-four hours after bombardment hypocotyls were infiltrated with substrate for assaying the β-glucorinidase activity encoded by the GUS gene. Following infiltration the hypocotyls were incubated at 37° C. for the overnight and then scored for GUS positive cells (blue color development) (Jefferson et al. 1987). Hypocotyls were stored in 100% (v/v) ethanol. Four independent experiments were carried out for these two kinds of gold particles. Each experiment was comprised of 2-3 replications. In each replicate, 6-8 hypocotyls were bombarded with gold particles. Average and standard errors of GUS positive cells showing blue color were calculated from observations of individual hypocotyls.

Transient Expression of GFP and DSRED2

Eight-day old soybean hypocotyls were bombarded with gold particles containing either GFP or DsRed2 reporter gene following the protocol described for transient expression of GUS in the previous section. Treatment comprising (i) 5 µg of pPadma45 (Rps1-k-2) or plasmid containing either mutant, or revertant of the Rps1-k-2 gene and (ii) 5/1 g of either pGFP or pDsRed2 plasmid (FIG. 15) were coated onto gold particles. In the empty vector control 5 μg of either pGFP or pDsRed2 plasmid was coated onto gold particles along with 5 μg of pPadma41. Gold particles containing Rps1-k-2, its mutants or revertants and pGFP were mixed with gold particles containing the empty vector and pDsRed2 in equal proportions. Similarly, gold particles containing Rps1-k-2, its mutants or revertants and pDsRed2 were mixed with gold particles containing the empty vector and pGFP in equal proportions. The Petri plates were placed in a particle inflow gun chamber at a distance of 10 cm from the particle accelerator and bombarded with mixed gold particles as described for the GUS reporter gene. Bombarded hypocotyls were incubated at 20-22° C. for overnight in dark.

Epifluorescence Microscopy

Epifluorescence microscopy was conducted using a Zeiss Axioplan 2 microscope. FITC (Fluorescein isothiocyanate) filter set containing HQ 480/40X excitation and HQ 450-650 nm emission filters was used for viewing hypocotyl cells for GFP expression, whereas the TRITC (Texas red isothiocyanate) filter set consisting of HQ545/30 excitation and HQ500-700 nm emission filters was used for viewing hypocotyl cells for DsRed2 expression about 24 h following bombardment. An imaging system (Axiocam HRC) comprised of Carl Zeiss vision software attached to the fluorescence microscope was used to capture the image. The number of GFP and DsRed2 positive cells was counted for each field at the 10× ocular magnification.

In an individual hypocotyls, total number GFP positive cells from bombardment of gold particles containing pPadma45 was divided by total number of DsRed2 positive cells resulting in from co-bombarded gold particles coated with the empty vector pPadma41 and pGDR to obtain ratio α ratio. In some experiments empty vector was replaced with mutants. Each experiment was conducted at least two times and in each experiment there were two replications. In each replication four hypocotyls were bombarded. Standard errors shown at the top of each bar diagram were calculated from at least eight ratios obtained from eight individual hypocotyls.

REFERENCES

Anderson, T. R., and R. I. Buzzell. 1992. Inheritance and linkage of the Rps7 gene for resistance to *Phytophthora* rot of soybean. Plant Dis. 76:958-959.

Aravind, L., and E. V. Koonin. 1999. Fold prediction and evolutionary analysis of the POZ domain: structural and evolutionary relationship with the potassium channel tetramerization domain. J. Mol. Biol. 285:1353-1361.

Axtell, M. J., T. W. McNellis, M. B. Mudgett, C. S. Hsu, and B. J. Staskawicz. 2001. Mutational analysis of the *Arabidopsis* RPS2 disease resistance gene and the corresponding *Pseudomonas syringae* avrRpt2 avirulence gene. Mol. Plant Microbe Interact. 14:181-188.

Bendahmane, A., G. Farnham, P. Moffett, and D. C. Baulcombe. 2002. Constitutive gain-of-function mutants in a nucleotide binding site-leucine rich repeat protein encoded at the Rx locus of potato. Plant J. 32:195-204.

Burnham, K. D., A. E. Dorrance, D. M. Francis, R. J. Fioritto, and S. K. St. Martin. 2003. Rps8, a new locus in soybean for resistance to *Phytophthora sojae*. Crop Sci. 43:101-105.

Chalfie, M., Y. Tu, G. Euskirchen, W. W. Ward, and D. C. Prasher. 1994. Green fluorescent protein as a marker for gene expression. Science 263:802-805.

Dangl, J. L., and J. D. Jones. 2001. Plant pathogens and integrated defense responses to infection. Nature 411:826-833.

Dinesh-Kumar, S. P., and B. J. Baker. 2000. Alternatively spliced N resistance gene transcripts: their possible role in tobacco mosaic virus resistance. Proc. Natl. Acad. Sci. USA 97:1908-1913.

Dodds, P., G. Lawrence, and J. Ellis. 2001. Six amino acid changes confined to the leucine-rich repeat beta-strand/beta-turn motif determine the difference between the P and P2 rust resistance specificities in flax. Plant Cell 13:163-178.

Ellis, J., P. Dodds, and T. Pryor. 2000. Structure, function and evolution of plant disease resistance genes. Curr. Opin. Plant Biol. 3:278-284.

Ellis, J. G., G. J. Lawrence, J. E. Luck, and P. N. Dodds. 1999. Identification of regions in alleles of the flax rust resistance gene L that determine differences in gene-for-gene specificity. Plant Cell 11:495-506.

Feys, B. J., and J. E. Parker. 2000. Interplay of signaling pathways in plant disease resistance. Trends Genet. 16:449-455.

Frame, B. R., H. Shou, R. K. Chikwamba, Z. Zhang, C. Xiang, T. M. Fonger, S. E. Pegg, B. Li, D. S. Nettleton, D. Pei, and K. Wang. 2002. *Agrobacterium tumefaciens*-mediated transformation of maize embryos using a standard binary vector system. Plant Physiol. 129:13-22.

Geddes, B. J., L. Wang, W. J. Huang, M. Lavellee, G. A. Manji, M. Brown, M. Jurman, J. Cao, J. Morgenstern, S. Merriam, M. A. Glucksmann, P. S. DiStefano, and J. Bertin. 2001. Human CARD12 is a novel CED4/Apaf-1 family member that induces apoptosis. Biochem. Biophys. Res. Commun. 284:77-82.

Goodin, M. M., R. G. Dietzgen, D. Schichnes, S. Ruzin, and A. O. Jackson. 2002. pGD vectors: versatile tools for the expression of green and red fluorescent protein fusions in agroinfiltrated plant leaves. Plant J. 31:375-383.

Hammond-Kosack, K. E., and J. D. G. Jones. 1996. Resistance gene-dependent plant defense responses. Plant Cell 8:1773-1791.

Haseloff, J., K. R. Siemering, D. C. Prasher, and S. Hodge. 1997. Removal of a cryptic intron and subcellular localization of green fluorescent protein are required to mark transgenic *Arabidopsis* plants brightly. Proc. Natl. Acad. Sci. USA 94:2122-2127.

Hickman, E. S., and K. Helin. 2002. The regulation of APAF1 expression during development and tumourigenesis. Apoptosis 7:167-171.

Hu, Y., M. A. Benedict, L. Ding, and G. Nunez. 1999. Role of cytochrome c and dATP/ATP hydrolysis in Apaf-1-mediated caspase-9 activation and apoptosis. EMBO J. 18:3586-3595.

Jefferson, R. A., T. A. Kavanagh, and M. W. Bevan. 1987. GUS fusions: b-glucuronidase as a sensitive and versatile gene fusion marker in higher plants. EMBO J. 6:3901-3907.

Leitz, R. A., G. L. Hartman, W. L. Pedersen, and C. D. Nickell. 2000. Races of *Phytophthora sojae* on soybean in Illinois. Plant Dis. 84:487.

Mantis, J., and B. W. Tague. 2000. Comparing the utility of b-glucuronidase and green fluorescent protein for detection of weak promoter activity in *Arabidopsis thaliana*. Plant Mol. Biol. Rep. 18:319-330.

Martin, G. B., A. J. Bogdanove, and G. Sessa. 2003. Understanding the functions of plant disease resistance proteins. Ann. Rev. Plant Biol. 54:23-61.

Meyers, B. C., K. A. Shen, P. Rohani, B. S. Gaut, and R. W. Michelmore. 1998. Receptor-like genes in the major resistance locus of lettuce are subject to divergent selection. Plant Cell 10:1833-1846.

Mindrinos, M., F. Katagiri, G.-L. Yu, and F. M. Ausubel. 1994. The *A. thaliana* disease resistance gene RPS2 encodes a protein containing a nucleotide-binding site and leucine-rich repeats. Cell 78:1089-1099.

Noel, L., T. L. Moores, E. A. van der Biezen, M. Pamiske, M. J. Danield, J. E. Parker, and J. D. Jones. 1999. Pronounced intraspecific haplotype divergence at the RPP5 complex disease resistance locus of *Arabidopsis*. Plant Cell 11:2099-2112.

Pan, Q., J. Wendel, and R. Fluhr. 2000. Divergent evolution of plant NBS-LRR resistance gene homologues in dicot and cereal genomes. J. Mol. Evol. 50:203-213.

Polzin, K. M., L. L. Lorenzen, T. C. Olson, and R. C. Shoemaker. 1994. An unusual polymorphic locus useful for tagging Rps1 resistance alleles in soybean. Theor. Appl. Genet. 89:226-232.

Restrepo, M. A., D. D. Freed, and J. C. Carrington. 1990. Nuclear transport of plant potyviral proteins. Plant Cell 2:987-998.

Schmitthenner, A. F. 1989. *Phytophthora* rot, p. 35-38, In J. B. Sinclair and P. A. Backman, eds. Compendium of soybean diseases. APS Press, St. Paul, Minn.

Schmitthenner, A. F., M. Hobe, and R. G. Bhat. 1994. *Phytophthora sojae* races in Ohio over a 10-year interval. Plant Dis. 78:269-276.

Tameling, W. I., S. D. Elzing a, P. S. Darmin, J. H. Vossen, F. L. Takken, M. A. Haring, and B. J. Cornelissen. 2002. The tomato R gene products I-2 and MI-I are functional ATP binding proteins with ATPase activity. Plant Cell 14:2929-2939.

Tao, Y., F. Yuan, R. T. Leister, F. M. Ausubel, and F. Katagiri. 2000. Mutational analysis of the *Arabidopsis* nucleotide binding site-leucine-rich repeat resistance gene RPS2. Plant Cell 12:2541-2554.

Taylor, C. B. 1997. Unraveling disease resistance specificities. Plant Cell:466-469.

Tornero, P., R. A. Chao, W. N. Luthin, S. A. Goff, and J. L. Dangl. 2002. Large-scale structure-function analysis of the *Arabidopsis* RPM1 disease resistance protein. Plant Cell 14:435-450.

Traut, T. W. 1994. The functions and consensus motifs of nine types of peptide segments that form different types of nucleotide-binding sites. Eur. J. Biochem. 222:9-19.

Van der Biezen, E. A., and J. D. Jones. 1998. Plant disease-resistance proteins and the gene-for-gene concept. Trends Biochem. Sci. 23:454-456.

Varagona, M., M. Purugganan, and S. Wessler. 1992. Alternative splicing induced by insertion of retrotransposons into the maize waxy gene. Plant Cell 4:811-820.

Warren, R. F., A. Henk, P. Mowery, E. Holub, and R. W. Innes. 1998. A mutation within the leucine-rich repeat domain of the *Arabidopsis* disease resistance gene RPS5 partially suppresses multiple bacterial and down mildew resistance genes. Plant Cell 10: 1439-1452.

Young, N. D. 2000. The genetic architecture of resistance. Curr. Opin. Plant. Biol. 3:285-290.

Zhang, Z., A. Xing, P. Staswick, and T. Clemente. 1999. The use of glufosinate as a selective agent in *Agrobacterium*-mediated transformation of soybean. Plant Cell Tiss. Org. Cult. 56:37-46.

FIGURE LEGENDS

FIG. 15A. Digramatic representations of vectors used in this investigation. 35S, the Cauliflower mosaic virus 35S promoter; GUS, B-glucuronidase; Nos 3',3'-end of the nopaline synthase gene; dsRed2, red fluorescent protein, GFP, green fluorescent protein; TEV-Tobacco etch virus 5'-nontranslated region; Rps1-k-2, a *Phytophthora* resistance gene. pISUAgron3, contains the 35S:GUS reporter gene in pTF101.1m vector; pGDR, contains the DsRed2 protein; pGFP, contains GFP; pISUAgron5, empty pTF101.1m-based vector that was used to develop the pISUAgron6 vector containing the 35S:Rps1-k-2 fusion gene; pPadma41, empty BlueScript-based vector that was used to develop pISUAgron6 containing the 35S:Rps1-k-2 fusion gene.

FIG. 15B. Amino acid sequence of the NB-ARC domain of Rps1-k-2. The residues that were substituted (Table 1) are shown in red bold font.

FIG. 16. Transient co-expression of Rps-1-k and GUS Gold particles coated with pISUAgron3 and pISUAgron6 were bombarded onto 8-day old etiolated soybean hypocotyls. Gold particles coated with plasmid pISUAgron3 and the empty vector pISUAgron5 were bombarded separately onto etiolated hypocotyls to serve as the control. (a) Expression of GUS in the soybean hypocotyls co-transformed with the empty binary vector. (b) Number of GUS positive cells/hypocotyl. Results are mean and standard errors from four independent experiments, each of which was replicated 2-5 times (each bar diagram represents mean and standard errors from 13 replications, raw data are presented in Supplementary Table 1). R; co-transformation with pISUAgron6 with pISUAgron3, V; co-transformation of pISUAgron5 with pISUAgron3.

FIG. 17. Transient co-expression of reporter genes.

Gold particles coated with pPadma41 (empty vector) and pGFP were mixed with gold particles coated with pPadma41 and pGDR in equal amounts and co-bombarded onto 8-day old etiolated hypocotyls. Expression of GFP and DsRed2 was monitored under a Zeiss Axioplan 2 microscope 24 h following bombardment. (a-b), Epifluorescence micrographs showing the expression of both GFP and DsRed2 in the same cell. (c) Histograms representing average proportions of cells expressing both GFP and DsRed2. R (red bar), represents percentage of cells showing expression of both reporter proteins when expressed over total number of DsRed2 positive cells. G (green bar) represents percentage of cells showing expression of both reporter proteins when expressed over total number of GFP positive cells. Bar diagrams represent means and standard errors calculated from observation of about 20 independent microscopic fields of four hypocotyls. About 200 DsRed2 or GFP positive cells were counted.

FIG. 18. Rps-1-k-2 inhibits the expression of GFP and DsRed2. Gold particles coated with pPadma45 and pGFP were co-bombarded with gold particles coated with pPadma41 and pGDR onto 8-day old soybean hypocotyls. In the reverse experiment gold particles coated with pPadma45 and pGDR were co-bombarded with gold particles containing pPadma41 and pGFP; and in the negative control gold particles coated with pPadma41 and pGFP were co-bombarded with gold particles coated with pPadma41 and pGDR. (a-b) Epifluorescence micrographs showing transient expression of GFP and DsRed2: (a), pPadma45 and pGFP co-bombarded with pPadma41 and pGDR and visualized for GFP. (b), The same microscopic field shown in (a) was then visualized for DsRed2 expression. Note that expression of DsRed2 but not GFP was detected in a cell of that microscopic field. (c-d), Epifluorescence micrographs showing transient expression of GFP and DsRed2: (c) pPadma45 and pGDR co-bombarded with pPadma41 and pGFP and visualized for DsRed2. (d) The same microscopic field shown in (c) was then visualized for GFP expression. Note that expression of GFP but not DsRed2 was detected in that microscopic field. (h) Results are relative transient expression of a reporter gene from co-transformation with pPadma45 (35S:Rps1-k-2) was calculated as a ratio over that of the other reporter gene co-transformed with pPadma41 (empty vector). R, red bar represents relative expression of DsRed2 (in ratio) from co-transformation with pPadma45 and pGDR over GFP expression levels from co-transformation of pGFP and pPadma41 in the same hypocotyls tissues. Note that both types gold particles were co-bombarded and same microscopic fields were evaluated for DsRed2 and GFP expression. R, green bar represents data of a similar experiment where GFP instead of DsRed2 was co-expressed with 35S:Rps1-k-2, and DsRed2 instead of GFP was co-transformed with the empty vector pPadma41 in the co-bombardment experiments. V, the vector control, in which reporter genes were co-expressed with the empty vector pPadma41. Red bar shows the relative transient expression of DsRed2 protein over GFP and likewise green bar shows the relative expression of GFP over DsRed2 in those negative control experiments. Note that both reporter proteins expressed equally when only empty vector was co-transformed with the either reporter gene in co-bombardment experiments. Results are from two different experiments, each containing two replications. Expression levels of the reporter gene with Rps1-k-2 were expressed as ratios over expression levels of the other reporter gene with the empty vector (internal control) from individual hypocotyls, and ratios calculated from 16 hypocotyls were used to calculate the mean and standard errors.

FIG. 19. Identification of amino acids necessary for Rps1-k-2-mediated putative cell death pathway. The reciprocal transient assay system described in FIGS. 3 and 4 was applied in evaluating rps1-k-2 mutants. (a-1), Epi-fluorescence micrographs of 35S:Rps1-k-2 or 35S:rps1-k-2 mutants co-expressed with DsRed2. With each construct combination gold particles coated with empty vector pPadma41 and pGFP were co-bombarded to serve as an internal control. (a-b), Rps1-k-2; (c-d), mutant G193E; (e-f), mutant V221A; (g-h), mutant D269A; (1-j), mutant L408F; (k–1), mutant F417S. (m), Relative transient expression levels (as ratios) of DsRed2, when pGDR was co-transformed with 35S:Rps1-k-2 or 14 35S:rps1-k-2 mutants, over GFP expression levels from the internal control comprising the empty vector pPadma41 and pGFP are presented. (n-y), Epi-fluorescence micrographs of 35S:Rps1-k-2 or 35S:rps1-k-2 mutants co-expressed with GFP. With each construct combination gold particles coated with empty vector pPadma41 and pGDR were co-bombarded to serve as an internal control. (n-o), Rps1-k-2; (p-q), mutant G193E; (r-s), mutant V221A; (t-u), mutant D269A; (v-w), mutant L408F; (x-y), mutant F417S. (z), Relative transient expression levels (as ratios) of GFP, when pGFP was co-transformed with 35S:Rps1-k-2 or 14 35S:rps1-k-2 mutants, over DsRed2 expression levels from the internal control comprising the empty vector pPadma41 and pGDR are presented. Two independent experiments, each containing two replications were conducted. In each replication total GFP or DsRed2 positive cells were counted from four transformed hypocotyls. Total number of positive GFP or DsRed2 cells in an individual hypocotyl was considered to calculate ratios. Bar diagrams represent means and standard errors of ratios from a total of 16 transformed hypocotyls.

FIG. 20A. Recovery of the Rps1-k-2-mediated putative cell-death phenotype among revertants. The reciprocal transient assay system described in FIGS. 3 and 4 was applied in evaluating revertants of all rps1-k-2 mutants showing loss of putative cell-death function (FIG. 5). (a-1) Epi-fluorescence micrographs of 35S:Rps1-k-2 or revertants co-expressed with GFP and vector pPadma41 co-expressed with DsRed2. (a-b), pPadma45; (c-d), revertant E193G; (e-f), revertant A221V; (g-h), revertant A269D (1-j), revertant F408L; (k–1), revertant S417F. (m), Relative transient expression levels (as ratios) of GFP, when pGFP was co-transformed with 35S:Rps1-k-2 or any of the five mutants or their respective revertants, over DsRed2 expression levels from the internal control comprising the empty vector pPadma41 and pGDR are presented. (n-y), Epi-fluorescence micrographs of 35S:Rps1-k-2 or mutants co-expressed with DsRed2 and empty vector pPadma41 with pGFP. (n-o), Rps1-k-2; (p-q), revertant E193G; (r-s), revertant A221V; (t-u), revertant A269D; (v-w), revertant F408L (x-y), revertant S417F. (z), Relative transient expression levels (as ratios) of DsRed2, when pGDR was co-transformed with 35S:Rps1-k-2 or any of the five mutants or their respective revertants, over GFP expression levels from the internal control comprising the empty vector pPadma41 and pGFP are presented. Two independent experiments, each containing two replications were conducted. In each replication total GFP or DsRed2 positive cells were counted from four transformed hypocotyls. Total number of positive cells in an individual hypocotyl was considered for calculating the ratios. Bar diagrams represent means and standard errors of ratios from a total of 16 individual hypocotyls.

FIG. 20B. Location of five essential amino acids required for the Rps1-k-2-mediated putative cell death pathway. CC, coiled-coil domain; NB-ARC, a nucleotide binding adaptor shared by APAF-1, certain R proteins and CED-4, and LRR, leucine rich regions.

The gray boxes are regions between the conserved domains. Black stars represent the locations of substituted amino acids that did not alter the Rps1-k-2-mediated putative cell death function. Red stars indicate the locations of five amino acids that are essential for the expression of the Rps1-k-2-mediated putative cell death function.

FIG. 21. Rps1-k-2 mediated putative cell death pathway is suppressed by co-expression of rps1-k-2 mutants. 35S:Rps1-k-2 was coated onto gold particles with individual mutants and a reporter gene. Corresponding mutants and the other reporter gene were co-bombarded to serve as an internal control. (a-j)) Epi-fluorescence micrographs of 35S:Rps1-k-2 and any of the five mutants co-expressed with GFP. With each combination of 35S:Rps1-k-2 and mutants pPadma41 and pGDR were co-bombarded to serve as an internal control. (a-b), mutant G193E; (c-d), mutant V221A (e-f); D269A (g-h), mutant L408F; (1-j), mutant F417S. (k), Relative transient expression levels (as ratios) of GFP, when pGFP was co-transformed with 35S:Rps1-k-2 or any of the five mutants, over DsRed2 expression levels from the internal control comprised of the respective mutant and pGDR are presented. (1-u) Epi-fluorescence micrographs of 35S:Rps1-k-2 and any one of the five mutants co-expressed with DsRed2. With each combination of 35S:Rps1-k-2 and mutants pPadma41 and pGFP were co-bombarded to serve as an internal control. (1-m), mutant G193E; (n-o), mutant V221A; (p-q), mutant D269A; (r-s), mutant L408F; (t-u), mutant F417S. (v), Relative transient expression levels (as ratios) of DsRed2, when pGDR was co-transformed with 35S:Rps1-k-2 or any of the five mutants, over GFP expression levels from the internal control comprised of the respective mutant and pGFP are presented. Two independent experiments, each containing two replications were conducted. In each replication total GFP or DsRed2 positive cells were counted from four transformed hypocotyls. Total number of GFP or DsRed2 positive cells from individual hypocotyls were used to determine the ratios. Bar diagrams in (k) and (v) represent means and standard errors from a total of 16 hypocotyls.

Example 6

The *Phytophthora* Resistance Gene Locus Rps1-k is Composed Primarily of Repetitive Sequences in Soybean A series of single Rps (resistance to *Phytophthora sojae*) genes has been protecting soybean from the root and stem rot disease caused by the oomycete pathogen, *Phytophthora sojae*. Among these genes, Rps1-k has been providing stable and broad-spectrum *Phytophthora* resistance in the major soybean-producing regions of the United States. Rps1-k has been mapped and cloned. Here we report the analyses of sequences of three overlapping BAC clones containing the 184,182 bp Rps1-k region. A shotgun sequencing strategy was applied in sequencing the BAC contig. Sequence analysis predicted a few full-length genes including two Rps1-k genes, Rps1-k-i and Rps1-k-2. The majority of the predicted genes are truncated and therefore most likely they are non-functional. A member of a highly abundant retroelement, SIRE1, was identified from the Rps1-k region. The Rps1-k region is primarily composed of repetitive sequences. Sixteen simple repeat and 63 tandem repeat sequences were identified from the locus. These data indicate that the Rps1 locus is located in a gene-poor region. The abundance of repetitive sequences in the Rps1-k region suggests that Rps1 is located in a heterochromatic region, which could be pericentromeric.

Introduction

Many plant disease resistance (R) genes from different plant species have been cloned and characterized; but are classified into a limited number of classes [12]. R genes are usually organized in clusters, and genes within one cluster are mostly derived from a common ancestor [3]. The clustering feature can facilitate the expansion of R gene number and the generation of new R gene specificities through recombination and positive selection [4]. Long contiguous sequences containing several R genes or resistance gene analogues (RGA) have been determined [5-7]. These sequences provided insights into the mechanisms of R gene evolution and generation of novel recognition specificity. Insertions of retroelements in genomic regions containing R genes or RGAs have been documented in these studies. Retroelements are suggested to create variability among paralogous R gene members [8].

Soybean (*Glycine max* L. Merr.) is a legume crop of great economical and agricultural importance across the world. Its estimated genome size is 1,115 Mb, of which approximately 40-60% is composed of repetitive sequence and is heterochromatic [9-11]. Repetitive DNA sequences have been shown to be the major determinant of plant genome sizes [12]. There are two main types of repetitive sequences, tandem repeat DNA sequences and dispersed DNA sequences such as retroelements [12]. Several soybean tandem repeats, SB92, STR120 and STRR102 have been reported [13-15]. It has been suggested that soybean has experienced at least two rounds of genome-wide duplications [16-18]. Although currently, densely saturated genetic maps, deep coverage bacterial artificial chromosome (BAC) and yeast artificial chromosome (YAC) libraries and a large collection of ESTs are available, our knowledge of soybean genome structure at the DNA sequence level is still largely limited [19-24].

Root and stem rot disease caused by *Phytophthora sojae* is one of the most destructive soybean diseases in the United States [25]. Use of *Phytophthora* resistance conferred by single dominant Rps genes has been providing reasonable protection of soybean against this pathogen. Rps1-k confers resistance to most races of *P. sojae*, and has been widely used for the past two decades [26]. We previously reported the isolation of two classes of functional *Phytophthora* resistance genes from the soybean Rps1-k locus [27]. We have also reported mapping of a large cluster of paralogous Rps1-k sequences to the Rps1-k region [28]. The Rps1-k locus has been mapped to the end of an approximately 600 kb contiguous sequences spanned by several overlapping BAC clones [28]. In the present study, to gain insights into the soybean genome organization and evolution of Rsp1-k genes we have sequenced and analyzed three of these BAC clones containing the Rps1-k locus.

Results

Sequence of Three BAC Clones Spanning the Rps1-k Locus

Rps1-k was previously mapped to a region flanked by two markers CG1 and TC1 [29]. To understand the composition of the Rps1-k region, three overlapping BAC clones, GS__18J19, GS-43D16 and GS__99I16, from the Rps1-k locus were chosen for sequencing [28]. A total of 4,093 reads (829, 1,189 and 2,065 reads for GS-18J19, GS__43D16 and GS-99116, respectively) were generated from these BAC clones. GS__18J19, GS__43D16 and GS__99I16 were sequenced to a 14-, 12- and 9 fold redundancies, respectively. A single contig of 38,533 bp (GenBank No. xxxx) was obtained for GS__18J19 after the initial assembly. Three and five cotigs were obtained from assembling of sequences derived from GS__43D16 and GS-99116, respectively. The resulting contigs of GS__43D16 and GS__99I16 were ordered into individual scaffolds manually, in which the order and orientation of the contigs were inferred by mate pairs (sequences obtained from both ends of a ~20 kb shotgun clone) [30]. The clones that span the gaps between two adjacent contigs were identified based on mate pairs and were used to obtain sequences of the gap regions. Primers for walking towards the gaps using these clones were designed based on the sequences of contig ends from which walking were initiated. To guarantee the high sequence quality, less sequenced regions were further sequenced by primer walking approach in which primers specific to a target region were used for sequencing. After initial assembly and gap filling, a total of 70,841 bp (GenBank No. xxxx) and 164,451 bp (GenBank No. xxxx) sequences were obtained from GS__43D16 for GS__99I16, respectively. The assembled GS__18J19 sequences represent one end of the GS__43D16.

Directional Sequencing of GS__43D16

Earlier, partial sequencing of the three BAC clones had allowed us to identify candidate Rps1-k genes. The functional identities of Rps1-k genes were confirmed through stable transformation in soybean [27]. Two classes of Rps1-k genes were identified. The three Class I Rps1-k genes are identical in their ORF sequences. The Class I gene, Rps1-k-3, showed a recombination breakpoint at the 3' untranslated region originating from sequence exchange between members of both classes of genes [27].

The existence of identical Rps1-k genes and abundant repetitive sequences made it very difficult to accurately assemble the sequences of the BAC clones; and we could not locate the recombinant Rps1-k-3 gene on the assembled sequences. With an effort to solve this problem, GS_43D16 considered containing Rps1-k-1, Rps1-k-2 and Rps1-k-3 [27], was subjected to directional sequencing using the EZ::TN <NotI/KAN-3> transposon of the EZ::TN in-Frame Linker Insertion Kit (Epicentre, Madison, Wis.). Two hundred and twenty-four EZ::TN <NotI/KAN-3> transposon insertion GS_43D16 clones were randomly selected for further analysis. To physically map transposon insertion sites, each clone was digested with NotI and hybridized to GS_43D16 end-specific probes in Southern blot analyses (FIG. 1). There are three NotI sites in GS_43D16; one in the insert soybean genomic DNA and two in the pBelloBAC11 vector flanking the cloning Hind i site. Therefore, NotI digestion of GS_43D16 resulted in three NotI fragments (FIG. 1); (I) a large DNA fragment of ~55 kb, (II) a small DNA fragment of ~15 kb, and (III) the pBelloBAC11 vector sequence. There are two NotI sites flanking the kanamycin resistance gene in the EZ::TN <NotI/KAN-3> transposon. Therefore, if there is a single transposon insertion in the GS_43D16 clone, then five fragments including the ~1.2 kb transposon, should be generated following NotI digestion (FIG. 1).

Of the analyzed 224 random transposon-inserted GS_43D16 clones, 162 were sown to contain the transposon in the large fragment; 40 of them in the small fragment; and 22 in the pBelloBAC11 vector. The frequency of transposon insertion to the three NotI fragments was proportional to the size of these fragments, with larger fragments showing more frequent insertions as compared to the smaller fragments. Clones containing transposon insertions in the vector pBelloBAC11 were not considered for further study. Approximate physical locations of transposon insertions in individual NotI genomic DNA fragments were determined by Southern analyses as shown in FIG. 1. Based on the physical location of transposon insertions, 114 GS_43D16 clones containing transposon insertions in either the 15 or 55 kb NotI fragment were selected for sequencing by using transposon end-specific primers. Only about 50% percent of the clones produced sequences that were readable. We performed pairwise sequence comparison between the assembled GS_43D16 sequence and sequences obtained from individual transposon inserted GS_43D16 clones and determined the transposon insertion sites in GS_43D16.

Among the randomly picked 224 transposon-inserted clones, although the number of transposon insertions is proportional to the size of NotI fragments, we did not observe any insertions in two regions, one of about 5 kb in the ~15 kb fragment and the other one is about 10 kb in the ~55 kb fragment. Whether this was due to biasness in transposon insertion or due to sampling variance is yet to be determined.

To further confirm the quality of 78,313 bp assembled GS_43D16 sequence was verified through restriction mapping. Clones carrying transposon insertions at various regions were selected and double digested with KpnI and NotI. The predicted KpnI-NotI restriction maps based on the assembled GS_43D16 sequence is shown in FIG. 2A. Eight fragments are expected from Kpn1 and NotI double digestion of GS_43D16. Only five fragments were resolved in the gel analyses, because some of the fragments are of similar sizes. For example, there are two 17 kb fragments termed Fragment I. Following digestion of clones carrying single transposons with both enzymes released two additional fragments including the 1.2 kb transposon. Depending upon the position of the transposon in a given KpnI or KpnI-NotI fragment two fragments of variable sizes were produced (Table 1). Comparison of observed fragment sizes with that of expected fragment sizes showed that there is general agreement between the observed and expected fragment sizes. SalI-NotI map (FIG. 2C) based on the assembled sequence was also verified by digesting GS-43D16 with SalI and NotI. Eight fragments were expected from the double digestion. Two fragments, 7.9 kb and 7.11 kb were not resolved and termed Fragment IV (FIGS. 2C and 2D). Smallest fragment (0.6 kb) is not shown in FIG. 2D. Taking these data together, we concluded that the generated GS_43D16 sequence represents the physical distance of the soybean DNA fragment of that clone and no large fragments were remained to be sequenced.

Gene Content of the Rsp1-k Locus

GS_18J19 overlaps with one end of GS_43D16. GS_99I16 comprised 51,109 bp sequences of GS_43D16. Between the overlapping sequences of GS_18J19 and GS_43D16 and between GS_43D16 and GS_99I16 we observed 99.99% and 99.84% identities, respectively. These results indicate high quality of the assembled sequences. We determined the gene contents in a contiguous 184,182 bp (GenBank No. xxxx) sequence carrying the Rps1-k locus derived from the GS_43D16 and GS_99I16 sequences. Genes were predicted with GeneScan and GeneMark.hmm ES-3.0 programs [31]. To obtain more accurate prediction, genes predicted from GENSCN and GeneMark.hmm, and/or sequences having similarities to soybean ESTs were further analyzed by different NCBI Blast programs and sequence alignment programs. Putative annotations of the predicted genes were accomplished by BlastP searches. The gene content in the Rsp1-k region appears to be poor. Only a few full-length genes were predicted including two coiled coil-nucleotide binding-leucine rich repeat (CC-NB-LRR)-type Rps1-k genes (FIG. 3, Table 2). Most of the identified genes are truncated. Genes were considered truncated when their predicted reading frames are partial. For example, the predicted cystein proteinase shares an 88% identity with the first 126 amino acids of a soybean cysteine proteinase protein (BAA06030) followed by a premature stop codon. The predicted protein product with armadillo/beta-catenin-like repeats has a 41% identity from amino acids 198 to 447 with an *Arabidopsis* protein NP_197434. BlastN search against the soybean EST database was performed to support our gene prediction. ESTs showing high similarities but no complete identities to all predicted genes including the truncated ones were identified (Table 2).

The Rps1-k Region is Composed of Repetitive Sequences

The major portion of the contiguous 184,182 bp sequence of the Rps1-k region is comprised of repetitive sequences including simple repeat sequences, tandem repeats and retroelements. The simple repeat sequences and tandem repeat sequences were identified using Sputnik and tandem repeats finder. Sixteen simple repeat sequences were identified (Table 3). Sixty-three tandem repeats were revealed with copy numbers ranging from 1.8 to 72 and unit length varying from 7 to 310 bp (Table 4). The consensus motif length of the tandem repeat containing 72 copies is 24 bp. Sequence data from individual reads confirmed that they are tandem repeats in head-to-tail orientation. This sequence was used to query the soybean GSS (genomic survey sequence) database and a number of sequences with high identities were revealed. The one (CL868124) showing highest identity to the consensus 24 bp tandem sequence came from the project on characterization of the heterochromatic, gene-poor centric regions of chromosomes of soybean.

Another abundant tandem repeat contains the consensus AATCAAG sequence. 12.3 copies of this repeat sequence were found between positions 163826 to 163911 and 11.3 copies between positions 1782654 to 178343. Several soybean tandem repeat sequences, SB92, STR120 and STR102, have been identified [13-15]. Seven copies of a tandem repeat sequence with 102 bp unit length were also found in the Rps1-k locus, but it shares no similarity with STR120 or STR102.

The ~20 kb intergenic sequence between Rps1-k-1 and Rps1-k-2 is primarily made up of repetitive sequences. Four simple repeat sequences were localized in this interval. Notably, a 220 bp sequence was found at two locations, one between positions 24349-24568 and the other one between positions 29994-30213. This sequence encodes part of a protein sharing high similarity to the receptor-like protein kinase, Xa21 (BAD27933).

A copia/Ty1-like retroelement, SIRE1-8, was identified from the Rps1-k locus [32]. The 9.5 kb sequence encoding the SIRE1-8 element was used to query the soybean EST database. Two ESTs (CB063565 and C0983516) showed 99% identity to part of the gag-pol encoding sequence, one EST showed 92% identity to the LTR and one EST exhibited similarities to the envelope-like sequence.

Discussion

Rps1-k was previously mapped to a region flanked by two markers CG1 and TC1 [28, 29]. In our present study, we sequenced three overlapping BAC clones from the region containing Rps1-k genes. As previously reported, a total of 13 subclones in the binary vector pTF101.1 generated from these BAC clones were shown to contain leucine-rich repeat sequences [27]. Each clone was sequenced completely. From sequencing these 13 clones in pTF101.1, we identified one binary clone that contains Rps1-k-3. However, this Rps1-k-3 gene was not found in the assembled GS_43D16 sequence. The binary vector pTF101.1 clone, p43-10, harboring Rps1-k-3 was originated from a library that was generated from GS_43D16 DNA digested partially with BamHI. Restriction mapping of GS-43D16 sequence for two restriction endonucleases, KpnI and SalI, in combination with NotI suggested strongly against presence of any possible DNA fragment containing Rps1-k-3 remained to be sequenced (FIG. 2; Table 1). p43-10 contains intact BamHI sites as expected at its both ends. p43-10 sequence is identical to a region of GS_43D16 spanning from its $1^{st}$ to $3^{rd}$ BamHI sites except for a region containing the $2^{nd}$ BamHI site (FIG. 4). The middle portion of the ~36 kb fragment between the first and third BamHI sites of GS_43D16 was deleted in the p43-10 binary clone presumably through an intramolecular recombination event [supplemental FIG. 1; 33]. We propose that the Rps1-k-3 gene must have originated through recombination in *Escherichia coli* during the generation of binary clones for complementation analysis. We identified Rps1-k-3 only from GS_43D16 [27]. Therefore, earlier we concluded that GS_18J19 and GS_99I16 did not overlap. Analysis of the assembled sequences suggested that the Rps1-k locus contains two distinct CC-NB-LRR type genes, Rps1-k-1 and Rps1-k-2.

The Rps1-k-1 and Rps1-k-2 genes are about 20 kb apart (FIG. 3). Plant R genes often occur in clusters, and genes within one cluster are usually derived from a common ancestor [3]. Three distinct CC-NBS-LRR gene families were identified in the Mla locus within a 240-kb region [6,34]. Plants have to generate novel resistance specificities to combat the quickly evolved pathogens. This clustering feature can facilitate the expansion of R gene numbers and the generation of new R gene specificities through recombination and positive selection [4]. The Rp1 rust resistance locus in maize has nine paralogues. It provides a good example of unequal recombination at a complex locus for expansion of a gene family [35]. An unequal crossing over event was detected at the Rps1-k region leading to tandem duplication [28].

Genomes of higher plants vary significantly in their size and complexity. Repetitive DNA sequences have been shown to be the major determinant of genome sizes in higher plants [12]. The prevalence of transposable elements and retroelements can promote unequal crossing-over leading to transposon-mediated rearrangements and gene duplications [36]. It has been hypothesized that transposable elements play a major role in the expansion and diversification of disease resistance gene family [8]. The abundance of retroelements has been observed in several genomic regions containing R genes or RGA loci, such as barley powdery mildew resistance gene, Mla, and Citrus virus resistance gene, Ctv [6,7]. The variability among 14 rice Xa21 gene members has been considered to be evolved mainly from the rearrangements mediated by transposon-like elements [8]. Rps1-k genes are arranged closely. About 38 copies of an R gene-like sequence were predicted to exist in the soybean genome. Most of the copies are clustered in the Rps1-k region [28]. A copia-like retroelement, Tgmr, has previously been reported from the Rps1-k region [37]. It is possible that retrotransposons facilitated the amplification of the Rps1-k gene family.

In many plant species such as *A. thaliana* and *M. tuncatula*, chromosome arms are differentiated into euchromatic and heterochromatic regions [38-40]. Recently, Lin et al. (2005) showed that in soybean heterocharomatic regions are also delimited from euchromatins. Studies in *Arabidopsis, Medicago* and tomato have shown that the euchromatin has a high gene density, whereas pericentromeric heterochromatin is largely comprised of repetitive sequences [40-42]. The Rps1-k region is composed of mostly tandem repeat sequences and retroelements (FIG. 3; Table 2). The gene content is very similar to that of a soybean BAC clone identified from the pericentromeric heterochromatin [13]. FISH mapping showed that SIRE1 and other retroelements are sequestered to the heterochromatic and/or pericentromeric regions [13]. Considering the fact that tandem repeat sequences and retroelements including SIRE1 are commonly abundant in heterochromatic and/or pericentromeric regions of the soybean genome, the Rps1-k region is most likely located in a heterochromatic region, which could be pericentromeric.

Microcolinearities of the Rps1-k locus with genomic sequences of plant species such as *Arabidopsis thaliana, Medicago truncatula* and *Lotus japonicus* (sequences available in the GenBank as of Aug. 24, 2006) were investigated. An R protein-like sequence identified in a *M. truncatula* genomic clone, MTH2-138E10, showed 65% identity with Rps1-k-2. However, there is no other syntenic region observed beyond this R gene-like sequence. A limited synteny of the Rps1-k locus was observed with the *L. japonicus* genome. Two copies of a resistance gene homolog that are located five kb apart in the *L. japonicus* genome showed 54%-58% identity with the Rps1-k-2 protein. These two genes are located in two overlapping *L. japonicus* BAC clones, LjT02F05 and LjT20J15. No nucleic acid sequence similarity was identified between these two *Lotus* BAC clones and the Rps1-k region beyond the Rps1-k genes.

It has been reported that plant disease resistance gene loci exhibit extensive loss of synteny. R gene-like sequences frequently lack syntenic map locations between the cereal species rice, barley, and foxtail millet [43]. Effort to clone the rice homolog of the barley Rpg1 gene was unsuccessful; because, although the DNA makers flanking Rpg1 were syntenic between rice and barley, the region containing the gene is absent in the syntenic rice genome [44]. These observations imply that R gene loci evolve faster than the rest of the genomes. This is further supported by comparative sequence analysis conducted in crucifers and grasses [45]. R genes may be located in less stable regions of the genome such as telomeric or pericentromeric regions where synteny is poorly conserved [46]. The tomato Tm-2 gene resides in a heterochromatic region near the centromere of chromosome 9 [47]. The Rpg1 gene is located near the telomere of the short arm of barley chromosome 1 [44]. The tomato Mi-1 gene is located at the border region between euchromatin and heterochromatin [48]. The lack of microsynteny of the Rps1-k region with the currently available genome sequences and abundance of repeat sequences in the locus suggest that Rps1-k is located in a heterochromatin region which could be pericentromeric.

Materials and Methods

BAC DNA Sequencing

The details of sequencing strategies of the three BACs, GS_18J19, GS-43D16 and GS_99I16 were described previously [27]. The sequence reads generated were assembled using the Phred/Phrap/Consed package [49,50].

Directional sequencing of GS_43D16

The EZ::TN <NotI/KAN-3> transposon insertion BAC clones were generated using the EZ::TN in-Frame Linker insertion kit (Epicentre, Madison, Wis.). The transposon insertion sites were mapped by NotI digestion. Southern blot analysis was carried out to physically map the position of transposon insertion in each clone. Both ends of GS_43D 16 were used as probes. The 5'-end sequence of GS-43D16 was amplified with primers: (i) GS_43D16 end1F: CTGTAAATTATAAACACATGCCAT (SEQ ID NO:183) and (ii) GS_43D16-end1R: GCTGAATTTCAGTGTAGTGGCGTTTAC (SEQ ID NO:184). The 3'-end sequence of GS_43D16 was amplified with primers: (i) GS_43D16 end2F: CCCATCCTCATTAATACTTCACACCAC (SEQ ID NO:185) and (ii) GS_43D16 end2R: GTAGTGGAAGTCTATAGTTGTATACCTCTC (SEQ ID NO:186). BAC DNA was prepared using the alkaline lysis minipreparation procedure. The clones were sequenced in a 96-well plate using either NotI/KAN-3 FP-2 or NotI KAN-3 R P-2 primer provided in the EZ::TN in-Frame Linker insertion kit (Epicentre, Madison, Wis.). Sequencing was conducted at the Iowa State University DNA Facility.

Gene Prediction and Sequence Analysis

Two gene prediction software packages were used in analyzing the BAC sequences: GENSCAN and GeneMark.hmm ES-3.0 (E—eukaryotic; S—self-training; 3.0—the version) [31]. The *Arabidopsis*-based scoring matrix was applied when using GENSCAN. *Arabidopsis, maize*, rice and *Medicago* were used as model species when GeneMark.hmm was applied. To more accurately predict gene content in the Rps1-k region, the predicted genes were further analyzed using different BLAST programs of the NCBI Basic Local Alignment Search Tool (Blast) server (www.ncbi.nlm.nih.gov/BLAST/): (i) discontiguous Mega Blast program with entrez query limited to *Arabidopsis*, lotus, *Medicago* and soybean; (ii) Blastn against the soybean EST database; (iii) BlastX and (iv) BlastP. EST distribution on the BAC sequence was evaluated with Blastn against the soybean EST database. The simple repeat sequences and tandem repeat sequences were identified using Sputnik (http://tandem.bu.edu/trf/trf.submit.options.html) and tandem repeats finder programs (http://tandem.bu.edu/trf/trf.submit.options.html), respectively.

Acknowledgments

We are grateful to Drs. Phil Becraft, Adam Bogdanove, Randy C. Shoemaker and Steven Whitham for invaluable discussion. This research has been supported by USDA-NRI Grant No. 2001-35301-10577 and a grant from Iowa Soybean Association and ISU Agronomy Department Endowment Fund.

LITERATURE CITED

1. Hammond-Kosack K E, Parker J E: Deciphering plant-pathogen communication: fresh perspectives for molecular resistance breeding. *Curr. Opin. Biotechnol.* 2003, 14:177-193.
2. Martin G B, Bogdanove A J, Sessa G: Understanding the functions of plant disease resistance proteins. *Annu. Rev. Plant Biol.* 2003, 54:23-61.
3. Richly E, Kurth J, Leister D: Mode of amplification and reorganization of resistance genes during recent *Arabidopsis thaliana* evolution. *Mol. Biol. Evol.* 2002, 19:76-84.
4. Michelmore R W, Meyers B C: Clusters of resistance genes in plants evolve by divergent selection and a birth-and-death process. *Genome Res.* 1998, 8:1113-1130.
5. Graham M A, Marek L F, Shoemaker R C: Organization, expression and evolution of a disease resistance gene cluster in soybean. *Genetics* 2002, 162:1961-1977.
6. Wei F, Wing R A, Wise R P: Genome dynamics and evolution of the Mla (powdery mildew) resistance locus in barley. *Plant Cell* 2002, 14:1903-1917.
7. Yang Z N, Ye X R, Molina J, Roose M L, Mirkov T E: Sequence analysis of a 282-kilobase region surrounding the citrus Tristeza virus resistance gene (Ctv) locus in *Poncirus trifoliata* L. Raf. *Plant Physiol.* 2003, 131:482-492.
8. Song W-Y, Pi L-Y, Wang G-L, Gardner J, Holsten T, Ronald P C: Evolution of the rice Xa21 disease resistance gene family. *Plant Cell* 1997, 9:1279-1287.
9. Arumuganathan K, Earle E D: Nuclear DNA content of some important plant species. *Plant Mol. Biol. Rep.* 1991, 9:208-218.
10. Goldberg R B: DNA sequence organization in the soybean plant. *Biochem. Genet.* 1978, 16:45-68.
11. Gurley W B, Hepburn A G, Key J L: Sequence organization of the soybean genome. *Biochim. Biophys. Acta* 1979, 561:167-183.
12. Kubis S, Schmidt T, Heslop-Harrison J S: Repetitive DNA Elements as a Major Component of Plant Genomes. *Annals of Botany* 1998, 82:45-55.
13. Lin J Y, Jacobus B H, SanMiguel P, Walling J G, Yuan Y, Shoemaker R C, Young N D, Jackson S A: Pericentromeric regions of soybean (*Glycine max* L. Merr.) chromosomes consist of retroelements and tandemly repeated DNA and are structurally and evolutionarily labile. *Genetics* 2005, 170:1221-1230.
14. Morgante M, Jurman I, Shi L, Zhu T, Keim P, Rafalski J A: The STR120 satellite DNA of soybean: organization, evolution and chromosomal specificity. *Chromosome Res.* 1997, 5:363-373.
15. Vahedian M A, Shi L, Zhu T, Okimoto R, Danna K, Keim P: Genomic organization and evolution of the soybean SB92 satellite sequence. *Plant Mol. Biol.* 1995, 29:857-862.

16. Blanc G, Wolfe K H: Widespread paleopolyploidy in model plant species inferred from age distributions of duplicate genes. *Plant Cell* 2004, 16:1667-1678.

17. Schlueter J A, Dixon P, Granger C, Grant D, Clark L, Doyle J J, Shoemaker R C: Mining EST databases to resolve evolutionary events in major crop species. *Genome* 2004, 47:868-876.

18. Shoemaker R C, Polzin K, Labate J, Specht J, Brummer E C, Olson T, Young N, Concibido V, Wilcox J, Tamulonis J P, Kochert G, Boerma H R: Genome duplication in soybean (*Glycine* subgenus *soja*). *Genetics* 1996, 144:329-338.

19. Cregan P B, Jarvik T, Bush A L, Shoemaker R C, Lark K G, Kahler A L, Kaya N, VanToai T T, Lohnes D G, Chung J, Specht J E: An integrated genetic linkage map of the soybean genome. *Crop Sci.* 1999, 39:1464-1490.

20. Danesh D, Penuela S, Mudge J, Denny R L, Nordstrom H, Martinez J P, Young N D: A bacterial artificial chromosome library for soybean and identification of clones near a major cyst nematode resistance gene. *Theor. Appl. Genet.* 1998, 96:196-202.

21. Marek L F, Shoemaker R C: BAC contig development by fingerprint analysis in soybean. Genome 1997, 40:420-427.

22. Meksem K, Zobrist K, Ruben E, Hyten D, Quanzhou T, Zhang H B, Lightfoot D: Two large-insert soybean genomic libraries constructed in a binary vector: applications in chromosome walking and genome wide physical mapping. *Theor. Appl. Genet.* 2001, 101:747-755.

23. Salimath S S, Bhattacharyya M K: Generation of a soybean BAC library, and identification of DNA sequences tightly linked to the Rps1-k disease resistance gene. *Theor. Appl. Genet.* 1999, 98:712-720.

24. Santra D K, Sandhu D, Tai T, Bhattacharyya M K: Construction and characterization of a soybean yeast artificial chromosome library and identification of clones for the Rps6 region. *Funct. Integr. Genomics* 2003, 3:153-159.

25. Wrather J A, Stienstra W C, Koenning S R: Soybean disease loss estimates for the United States from 1996 to 1998. *Can. J. Plant Pathol.* 2001, 23:122-131.

26. Schmitthenner A F, Hobe M, Bhat R G: *Phytophthora sojae* races in Ohio over a 10-year interval. *Plant Dis.* 1994, 78:269-276.

27. Gao H, Narayanan N N, Ellison L, Bhattacharyya M K: Two classes of highly similar coiled coil-nucleotide binding-leucine rich repeat genes isolated from the Rps1-k locus encode *Phytophthora* resistance in soybean. *Mol. Plant Microbe Interact.* 2005, 18:1035-1045.

28. Bhattacharyya M K, Narayanan N N, Gao H, Santra D K, Salimath S S, Kasuga T, Liu Y, Espinosa B, Ellison L, Marek L, Shoemaker R, Gijzen M, Buzzell R I: Identification of a large cluster of coiled coil-nucleotide binding site-leucine rich repeat-type genes from the Rps1 region containing *Phytophthora* resistance genes in soybean. Theor. Appl. Genet. 2005, 111:75-86.

29. Kasuga T, Salimath S S, Shi J, Gijzen M, Buzzell R1, Bhattacharyya M K: High resolution genetic and physical mapping of molecular markers linked to the *Phytophthora* resistance gene Rps1-k in soybean. *Mol. Plant-Microbe Interact.* 1997, 10:1035-1044.

30. Venter J C, Adams M D, Myers E W, Li P W, Mural R J, Sutton G G, Smith H O, Yandell M, Evans C A, Holt R A, Gocayne J D, Amanatides P, Ballew R M, Huson D H, Wortman J R, Zhang Q, Kodira C D, Zheng X H, Chen L, Skupski M, Subramanian G, Thomas P D, Zhang J, Gabor Miklos G L, Nelson C, Broder S, Clark A G, Nadeau J, McKusick V A, Zinder N, Levine A J, Roberts R J, Simon M, Slayman C, Hunkapiller M, Bolanos R, Delcher A, Dew I, Fasulo D, Flanigan M, Florea L, Halpern A, Hannenhalli S, Kravitz S, Levy S, Mobarry C, Reinert K, Remington K, Abu-Threideh J, Beasley E, Biddick K, Bonazzi V, Brandon R, Cargill M, Chandramouliswaran I, Charlab R, Chaturvedi K, Deng Z, Di Francesco V, Dunn P, Eilbeck K, Evangelista C, Gabrielian A E, Gan W, Ge W, Gong F, Gu Z, Guan P, Heiman T J, Higgins M E, Ji R R, Ke Z, Ketchum K A, Lai Z, Lei Y, Li Z, Li J, Liang Y, Lin X, Lu F, Merkulov G V, Milshina N, Moore H M, Naik A K, Narayan V A, Neelam B, Nusskern D, Rusch D B, Salzberg S, Shao W, Shue B, Sun J, Wang Z, Wang A, Wang X, Wang J, Wei M, Wides R, Xiao C, Yan C, et al.: The sequence of the human genome. *Science* 2001, 291:1304-1351.

31. Lomsadze A, Ter-Hovhannisyan V, Chemoff Y O, Borodovsky M: Gene identification in novel eukaryotic genomes by self-training algorithm. *Nucleic Acids Res.* 2005, 33:6494-6506.

32. Laten H M, Havecker E R, Farmer L M, Voytas D F: SIRE1, an endogenous retrovirus family from *Glycine max*, is highly homogeneous and evolutionarily young. *Mol. Biol. Evol.* 2003, 20:1222-1230.

33. Weisberg R A, Adhya S: Illegitimate recombination in bacteria and bacteriophage. *Annu. Rev. Genet.* 1977, 11:451-473.

34. Wei F, Gobelman-Werner K, Morroll S M, Kurth J, Mao L, Wing R, Leister D, Schulze-Lefert P, Wise R P: The Mla (powdery mildew) resistance cluster is associated with three NBS-LRR gene families and suppressed recombination within a 240-kb DNA interval on chromosome 5S (1H S) of barley. *Genetics* 1999, 153:1929-1948.

35. Hulbert S H, Webb C A, Smith S M, Sun Q: Resistance gene complexes: evolution and utilization. *Annu. Rev. Phytopathol.* 2001, 39:285-312.

36. Fedoroff N: Transposons and genome evolution in plants. *Proc. Natl. Acad. Sci. USA* 2000, 97:7002-7007.

37. Bhattacharyya M K, Gonzales R A, Kraft M, Buzzell R I: A copia-like retrotransposon Tgmr closely linked to the Rps1-k allele that confers race-specific resistance of soybean to *Phytophthora sojae*. *Plant Mol. Biol.* 1997, 34:255-264.

38. Fransz P, Armstrong S, Alonso-Blanco C, Fischer T C, Torres-Ruiz R A, Jones G: Cytogenetics for the model system *Arabidopsis thaliana*. *Plant J.* 1998, 13:867-876.

39. Fransz P F, Armstrong S, de Jong J H, Parnell L D, van Drunen C, Dean C, Zabel P, Bisseling T, Jones G H: Integrated cytogenetic map of chromosome arm 4S of *A. thaliana*: structural organization of heterochromatic knob and centromere region. *Cell* 2000, 100:367-376.

40. Kulikova O, Gualtieri G, Geurts R, Kim D J, Cook D, Huguet T, de Jong J H, Fransz P F, Bisseling T: Integration of the FISH pachytene and genetic maps of *Medicago truncatula*. *Plant J.* 2001, 27:49-58.

41. Initative A G: Analysis of the genome sequence of the flowering plant *Arabidopsis thaliana*. *Nature* 2000, 408:796-815.

42. Wang Y, Tang X, Cheng Z, Mueller L, Giovannoni J, Tanksley S D: Euchromatin and pericentromeric heterochromatin: comparative composition in the tomato genome. *Genetics* 2006, 172:2529-2540.

43. Leister D, Kurth J, Laurie D A, Yano M, Sasaki T, Devos K, Graner A, Schulze-Lefert P: Rapid reorganization of resistance gene homologues in cereal genomes. *Proceedings of the National Academy of Science USA* 1998, 95:370-375.

44. Han F, Kilian A, Chen J P, Kudrna D, Steffenson B, Yamamoto K, Matsumoto T, Sasaki T, Kleinhofs A:

Sequence analysis of a rice BAC covering the syntenous barley Rpg1 region. *Genome* 1999, 42:1071-1076.

45. Gale M D, Devos K M: Plant comparative genetics after 10 years. *Science* 1998, 282:656-659.

46. Michelmore R: Genomic approaches to plant disease resistance. *Curr. Opin. Plant Biol.* 2000, 3:125-131.

47. Motoyoshi F, Ohmori T, Murata M: Molecular characterization of heterochromatic regions around the Tm-2 locus in chromosome 9 of tomato. *Symp. Soc. Exp. Biol.* 1996, 50:65-70.

48. Zhong X B, Bodeau J, Fransz P F, Williamson V M, van Kammen A, de Jong J H, Zabel P: FISH to meiotic pachytene chromosomes of tomato locates the root-knot nematode resistance gene Mi-1 and the acid phosphatase gene Aps-1 near the junction of euchromatin and pericentromeric heterochromatin of chromosome arms 65 and 6L, respectively. *Theor. Appl. Genet.* 1999, 98:365-370.

49. Ewing B, Hillier L, Wendl M C, Green P: Base-calling of automated sequencer traces using phred. I. Accuracy assessment. *Genome Res.* 1998, 8:175-185.

50. Gordon D, Abajian C, Green P: Consed: a graphical tool for sequence finishing. *Genome Res.* 1998, 8:195-202.

TABLE 1A

Restriction fragments produced from the KpnI-NotI double digestion of GS_43D16 clones carrying the EZ::TN <NotI/KAN-3> transposon.

| Clone ID | Location of the transposon[1] | Fragment size from KpnI/NotI double digestion[2] Observed | Expected[3] |
|---|---|---|---|
| 120 | 15,171 | ~10 kb, —[4] | 0.1 kb, 10.1 kb |
| 29 | 20,255 | ~5.5 kb, ~4.5 kb | 5.2 kb, 4.9 kb |
| 205 | 38,493 | ~15 kb, — | 15.6 kb, 1.5 kb |
| 66 | 39,577 | ~14.6 kb, 2.6 kb with Fragment 3. | 14.6 kb, 2.6 kb |
| 65 | 42,203 | ~11.9 kb, 6 kb | 11.9 kb, 5.2 kb |
| 147 | 45,914 | ~10 kb with Fragment 3, ~8 kb | 8.9 kb, 8.2 kb |
| 99 | 49,522 | ~12.5 kb, 4.6 kb with Fragment 7. | 12.5 kb, 4.6 kb |
| 36 | 68,935 | ~14.5 kb, ~3 kb | 14.8 kb, 2.5 kb |

[1]The sequence flanking the transposon of the transposon inserted GS_43D16 clones were compared with the assembled GS_43D16 sequence.
[2]Fragments originating from transposon insertion.
[3]The expected fragments sizes based on the restriction map of the assembled GS_43D16 sequence and location of transposon insertion.
[4]The small fragment was not detected.

TABLE 2A

Gene annotations of the Rps1-k region

| Gene ID | Position[1] | Predicted gene annotation | Closest protein homolog | BLASTP E value | Soybean ESTs[2] ($E \leq e^{-50}$) |
|---|---|---|---|---|---|
| 1 | 792-4102 (+) | RNA-directed DNA polymerase | *Medicago truncatula* ABE92772 | $8e^{-04}$ | 0 |
| 2 | 12913-12472 (−) | Putative translational activator | *Oryza sativa* AAT77858 | $3e^{-10}$ | 0 |
| 3 | 14946-14674 (−) | Retrotransposon gag protein | *Medicago truncatula* ABE90017 | $1e^{-13}$ | 0 |
| 4 | 18019-21708 (+) | Rps1-k-1 | *Glycine max* AY963292 | 0 | 14 |
| 5 | 30186-32800 (+) | Unknown protein/Exocyst complex component 2 | *Arabidopsis thaliana* NP_173541, NP_177811 | 0.001 | 0 |
| 6 | 35179-34161 (−) | Possible ATP adenylyltransferase | *Synechococcus* sp. WH ZP_01086468 | 0.11 | 0 |
| 7 | 42452-46201 (+) | Rps1-k-2 | *Glycine max* AY963293 | 0 | 14 |
| 8 | 63302-62705 (−) | CBL-Interacting protein kinase 15 Serine/threonine Kinase (partial seudogene) | *Arabidopsis thaliana* NP_195801 *Persea Americana* AAL23677 | $6e^{-69}$ $3e^{-68}$ | 4 |
| 9 | 69126-68921 (−) | Ribosomal protein S6 | *Glycine max* AAS47511 | $4e^{-7}$ | 17 |
| 10 | 72246-72004 (−) | Ribonuclease H | *Arabidopsis thaliana* AAF_23831 | $9e^{-6}$ | 0 |
| 11 | 74095-74446 (+) | Putative gag-pol polyprotein | *Solanum demissum* AAW28578 | $8e^{-25}$ | 0 |
| 12 | 76950-78815 (+) | Conserved hypothetical protein | *Medicago truncatula* ABD32262 | $3e^{-40}$ | 4 |
| 13 | 79282-86280 (+) | Gag/pol polyprotein | *Pisum sativum* AAQ82033 | 0 | 19 |

TABLE 2A-continued

Gene annotations of the Rps1-k region

| Gene ID | Position[1] | Predicted gene annotation | Closest protein homolog | BLASTP E value | Soybean ESTs[2] ($E \leqq e^{-50}$) |
|---|---|---|---|---|---|
| 14 | 86648-89762 (+) | Hypothetical protein/envelope-like protein | *Arabidopsis thaliana* AAR99360, AAD28650 | 0.23 | 0 |
| 15 | 90317-92266 (+) | Hypothetical 65 kDa avirulence protein in avrBs3 region | *Xanthomonas campestris* pv. vesicatoria P14729 | $5e^{-5}$ | 7 |
| 16 | 92658-96559 (+) | Gag-pol polyprotein Integrase | *Zea Mays* AAM94350 | $2e^{-147}$ | 21 |
| 17 | 96817-97301 (+) | | *Gossypium hirsutum* AAP43919 | $1e^{-63}$ | 0 |
| 18 | 97430-97881 (+) | Putative retrotransposon polyprotein | *Ipomoea batatas* AAV88076 | $6e^{-27}$ | 0 |
| 19 | 102494-98487 (−) | Putative non-LTR retroelement reverse transcriptase(LINE-1 reverse transcriptase homolog) | *Arabidopsis thaliana* AAC63844 | $1e^{-32}$ | 0 |
| 20 | 111981-102293 (−) | Protein binding with ARM, Armadillo/beta-catenin-like repeats) (middle part 198-447) | *Arabidopsis thaliana* NP_197434 | $6e^{-37}$ | 0 |
| 21 | 113419-113916 (+) | NADH dehydrogenase subunit 1 (only the N-terminal 70 aa) | *Trichosurus vulpecula* NP_149931 | 3.9 | 77 |
| 22 | 114088-115118 (+) | MAD2 (only the N-terminal 65 aa) | *Triticum aestivum* BAD90977 | $3e^{-17}$ | 5 |
| 23 | 117048-116804 (−) | Cytochrome c oxidase subunit II (the N-terminal 40 aa) | *Cynomys ludovicianus* AAK52712 | 5.1 | 2 |
| 24 | 117709-119789 (+) | Cysteine proteinase Vacuolar processing enzyme precursor (the N-terminal 118 aa) | *Glycine max* BAA06030 P49045 | $3e^{-49}$ | 13 |
| 25 | 123937-123409 (−) | Unknown protein (partial pseudogene) | *Arabidopsis thaliana* NP_190603 | $2e^{-26}$ | 3 |
| 26 | 127141-126821 (−) | L-lactate dehydrogenase (partial pseudogene) | *Lycopersicon esculentum* CAA71611 | $9e^{-27}$ | 7 |
| 27 | 131083-132033 (−) | Ovarian tumour | *Medicago truncatula* ABD33214 | $9e^{-6}$ | 0 |
| 28 | 131753-138850 (−) | Glycoside hydrolase Integrase, catalytic region (partial pseudogene) | *Medicago truncatula* ABD33337 *Medicago truncatula* ABD32527 | 0 | 6 |
| 29 | 139054-139575 (+) | Unnamed protein product (c-terminal 173 aa) | *Oryza sativa* NP_912905 | $5e^{-60}$ | 3 |
| 30 | 140361-140014 (−) | Gag-pol polyprotein | *Glycine max* AAQ73529 | $1e^{-34}$ | 3 |
| 31 | 143050-141148 (−) | Glycoside hydrolase, family 1, Zinc finger, CCHC-type; Ribonuclease H fold | *Medicago truncatula* ABD333337 | $2e^{-54}$ | 0 |
| 32 | 145152-148184 (+) | Dynein | *Oncorhynchus mykiss* CAA33503 | $1e^{-10}$ | 4 |
| 33 | 145722-145277 (−) | Prion-like Q/N-rich domain protein PQN-33 | *Gallus gallus* XP_428546 | $6e^{-48}$ | 3 |

TABLE 2A-continued

Gene annotations of the Rps1-k region

| Gene ID | Position[1] | Predicted gene annotation | Closest protein homolog | BLASTP E value | Soybean ESTs[2] (E ≦ $e^{-50}$) |
|---|---|---|---|---|---|
| 34 | 154355-155745 (+) | Oxidoreductase (pseudogene) | *Arabidopsis thaliana* NP_201530 | $2e^{-21}$ | 7 |
| 35 | 159487-160392 (+) | Gag/pol polyprotein | *Pisum sativum* AAQ82037 | $5e^{-28}$ | 9 |
| 36 | 165713-166447 (+) | Glycoside hydrolase, family 1, Zinc finger, CCHC-type; Ribonuclease H fold | *Medicago truncatula* ABD333337 | $6e^{-29}$ | 1 |
| 37 | 167488-176781 (−) | SIRE1-8 retroelement | *Glycine max* AY205610 | 0 | 5 |

[1]+ indicates the coding sequence is on the forward sequence, while − indicates the coding sequence is on the reverse sequence.
[2]Soybean expressed sequence tags showing similarities to the target sequence at a level of significance, E value ≦ $e^{-50}$

TABLE 3A

Simple repeat sequences in the Rps1-k region

| Position | Repeat Unit | Copy Number |
|---|---|---|
| 7619-7663 | AT | 22 |
| 9814-9851 | AT | 19 |
| 24196-24231 | AT | 18 |
| 34682-34732 | AT | 25 |
| 38898-38960 | AAT | 21 |
| 41328-41354 | AAT | 9 |
| 51716-51901 | AT | 93 |
| 53915-53944 | AT | 15 |
| 59145-59168 | TC | 12 |
| 64934-64989 | AT | 28 |
| 110292-110313 | AT | 22 |
| 112406-112477 | AT | 36 |
| 116097-116116 | AT | 10 |
| 116665-116714 | AT | 25 |
| 127258-127281 | AG | 12 |
| 181688-181759 | AT | 36 |

Table 4A

Tandem repeat sequences in the Rps1-k region

| Position | Consensus sequence of tandem repeat unit | Copy number | SEQ ID NO: |
|---|---|---|---|
| 4872-4907 | TTAATAAATTTATT | 2.6 | 187 |
| 5279-5311 | TTTATT | 2.5 | |
| 7219-7253 | TTTTATTATTTAAATAT | 2 | 188 |
| 7328-7366 | TTTTAAGTTAACATAAATT | 2 | 189 |
| 13986-14041 | CTTATATTTTTTTTAT | 3.5 | 190 |
| 14069-14121 | TTTAAATCTTTTATTTTTACC | 2.5 | 191 |
| 28228-28272 | TTTATTTATAAGATTATTTAAT | 2 | 192 |
| 34767-34826 | ATGCAAACATATATACATGC | 2.9 | 193 |
| 65181-65235 | TCATTACTAAAAAAAAAATAG | 2.8 | 194 |
| 65966-66017 | GCCAGCATGCATGTATATC | 2.7 | 195 |
| 70677-70718 | TAAAAAGTTGAATAGATAC | 2.2 | 196 |
| 72634-72694 | CATTAAGTTCTTTTAATTCCTAGGTTAGTGG | 2 | 197 |
| 75090-75128 | CGTTCTTCAT | 3.8 | 198 |
| 87791-87926 | TGAATATATATAGCATGAAAATGCCTTGCAAAATA | 3.9 | 199 |
| 89787-89849 | AAATAGAAAAGGAAAGAAAATG | 2.9 | 200 |
| 90350-90511 | AAAAAGAAAAGAAAGGAAATTCCCAATCAAAGAGA AAGC | 3.8 | 201 |
| 90381-90538 | GAGAAAGCAAAAAGAAAAGAAAGGAAATTCCCAAT CAAAGAGTGG | 3.5 | 202 |
| 91333-92076 | TACGCGGAGATACCTTACGGTTATCCGCACCCCCTTT GCCATTCAGACACAGTCGTGTCCGTTGGCAAGCAGA GACCAAGTTTGGTCATTCTGCACACATGA | 7.3 | 203 |
| 92743-92779 | GCTCGCCTGGGCGAGCTGA | 1.9 | 204 |
| 98273-98333 | CATTAAGTTCTTTCAATTCATAGGTTAGTGG | 2 | 205 |
| 113516-113540 | AAAAACCGTCTTA | 1.9 | 206 |
| 120828-120857 | TTTTTTTTTCC | 2.7 | 207 |
| 122442-122512 | ATCAAATAAAATGCTTGCAGATCA | 3 | 208 |

Table 4A-continued

Tandem repeat sequences in the Rps1-k region

| Position | Consensus sequence of tandem repeat unit | Copy number | SEQ ID NO: |
|---|---|---|---|
| 124367-124513 | AAAAAAAATTGAAGATTCTAAGACAGTTTTTAGGGA AAACCGTCTTAGAATGTCTTATTTTAAATAAAAAAA AATT | 2 | 209 |
| 133966-134004 | AATCAAAGAACAACTCAAGTG | 1.9 | 210 |
| 134057-134089 | TCAAGAA | 4.9 | |
| 135918-136076 | GATCCACAAGGGATGTACCCTCCCTTATTCTCATTAC AACAACCCAAGTAGATGTACCCTCCACT | 2.3 | 211 |
| 136235-136365 | AAGGGAGAAGAGAGACACAAAAAGAATTCAGGCGG TTAGTCCTTGTCGATTCTTTTTGGAA | 2.2 | 212 |
| 137034-137101 | TCTTCTCTTGAATCTTGAATTCAA | 2.9 | 213 |
| 144892-144919 | AGAAAAGGAAAAA | 2 | 214 |
| 145379-147112 | GGACTACACGTCCTCGCCTTCAGA | 72 | 215 |
| 147479-147972 | GGGATCGCGCCCACAAGACACCCAGTGGACCCGAAG GAGTCCAACAGGGCCCTGGGGTTTCCAGCTCTGGTT ACGGGCCTCTGTCAGTCCTACAGGGTGCCCGTCCCCC CCAGCAAGGTCACCCCATCGTAACATAGGTAACTAT GCACATCTCTCAACTGATTTCTGATGCCATCCAATAT TTGCA | 2.6 | 216 |
| 148467-148657 | AAAAATACCTCACAAAATATATATATATTATGTTTAG GTAGCAAGATACCTTGGATACACATGTATATAGC | 2.7 | 217 |
| 149273-149361 | AAAGAAAGTTCCCGATCAAAGATCGAAAGAAAACAA AGAGAAAA | 2 | 218 |
| 150401-150651 | GTATGGTTATCAGCACCTGTCGTCAACCAGGGGCAA ACGAGCCCGTTGACGCGCAGAGACTAACGTCATCTT CTGCACCTTTTGTCAACCAGAGACAGCGAGTCCAAT GACATGTGGAGATACCCAAGCGATTATCC | 1.8 | 219 |
| 150612-151127 | GCACCTTTTGTCATCCAGAGACAGCGAGTCCGATGA CATGCGAGGGTACCGTATGGTTATCC | 8.3 | 220 |
| 150799-150931 | CACCTTTCGTCAACCAGGGGCAAACGAGCCCATTGA CGCGCAGAGACTAACGTCGTCTTCTG | 2.1 | 221 |
| 150550-151365 | GCACCTTTCGTCAACCAGGGGCAAGCGAGCCCGTTG ACGCGCAGAGACTAACGTCGTCTTCTGCACCTTTTGT CAACCAGAGATAGCGAGTCCGATGACATGCGAGGGT AACGTATGGTTATCCGCACCTTTTTTCATCCAGAGAC AGCGAGTCCGATGACATGCGGGGGTACCGTATGGTT ATCCGCACCTTTTGTCATCCACAGACGGCAAGTCCGA TGACACGCGGAGGTACCGTATGGTTATCCACACCTTT CGTCAACCAGGGGCAAACGAGCCCATTGACGCACAG AGACTAACGTCGTCTTCC | 2.6 | 222 |
| 150536-151060 | CCGTATGGTTATCACACCTTTCGTCAACCAGGGGCAA ACGAGCCCATTGACGCGCAGAGACTAACGTCGTCTT CTGCACCTTTCGTCAACCAGAGAGAGCGAGCCCAAT GAATGCGAGGCTAACGATCGTTATCCGCACCTTTTAT CATCCAGAGACGGCTAGTCCGATGACATGCGGGGGT ACCGTATGGTTATCCGCACCTTTTGTCATCCACAGAC AGCAAGTCCGATAACACGCAGGGGTA | 2.1 | 223 |
| 150901-151386 | CGCAGAGACTAACGTCGTCTTCCGCACCTTTTGTCAT CCAGAGATAGCGAGTCCGATGACATGCGGAGGTACC GTATGGTTATCCGCACCTTTTGTCAACCAGAGGCAAG CGAGTCCGTTGACA | 3.9 | 224 |
| 151985-152116 | AATCCGTAAAGTTTCGCAACATTCTGGAAGTCAAAA CAAGTATTGCTGCAC | 2.6 | 225 |
| 152550-152596 | TTCTTCATCG | 4.6 | 226 |
| 152558-152597 | CGTTCTTCATCGTTCTTCGTT | 1.9 | 227 |
| 153216-153398 | CCAAGAGATCGTTAATGGTCCAACGCCTTAACGTTTC TCTCCTTTCAAAA | 3.6 | 228 |
| 153555-153596 | AAAAAAGACAAAAAACAT | 2.3 | 229 |
| 156483-156603 | ATCAAACATCACTTGAGATCGTTTCAAGGTCCAACG CCTTAACCATTCTCTCCGCTTTTC | 2 | 230 |
| 161707-161856 | ACATCTGAGAAGAAAACTCATTCGACCAGGAGCTCA TGGAAAATTCCCAAAGACAATTGTGATAGTAGGGT | 2.1 | 231 |
| 162626-162804 | TTTTAGAGGACTCAAAGTCCTCACCTTTATC | 5.8 | 232 |
| 163722-163780 | ATCAAAGAACAACTCAAGTGA | 2.9 | 233 |
| 163762-163815 | GAATCAAGAACAAGTCAAGACTCAA | 2.1 | 234 |
| 163765-163818 | TCAAGAATCAAGAAGAAT | 2.9 | 235 |
| 163826-163911 | AATCAAG | 12.3 | |
| 164281-164330 | TTCAAAAAGGTTTTAACTTT | 2.5 | 236 |
| 164461-164485 | TTGAATCTCT | 2.5 | 237 |
| 166799-166839 | AGTATTTTCAAAAAT | 2.9 | 238 |
| 168846-168891 | TCATAAATCATGCATAATATCCT | 2 | 239 |
| 172682-172713 | TTTTCTGCA | 3.4 | |
| 178161-178219 | ATCAAAGAACAACTCAAGTGA | 2.9 | 240 |
| 178201-178254 | GAATCAAGAACAAGTCAAGACTCAA | 2.1 | 241 |
| 178204-178257 | TCAAGAATCAAGAAGAAT | 2.9 | 242 |

Table 4A-continued

Tandem repeat sequences in the Rps1-k region

| Position | Consensus sequence of tandem repeat unit | Copy number | SEQ ID NO: |
|---|---|---|---|
| 178265-178343 | AATCAAG | 11.3 | |
| 178713-178762 | TTCAAAAAGGTTTTAACTTT | 2.5 | 243 |
| 180693-180809 | AAAGGCACGCTAAGCCCAATTCCAACCGAGAGGAAG TGCACTGAGCGGCCC | 2.3 | 244 |
| 183350-183378 | AATTTATGGAGCCA | 2.1 | 245 |

FIG. 22. Physical mapping of the location of EZ::TN <NotI/KAN-3> transposon insertion in a soybean bacterial artificial chromosome. Individual GS_43D16 clones containing the EZ::TN <NotI/KAN-3> transposon were digested with NotI. NotI digestion released three fragments from GS_43D16, Fragment I, II and III, which are shown in the last lane. Note that fragment III is comprised of the pBelloBAC11 vector sequence. A, GS_43D16 clones carrying the transposon in the NotI Fragment I. The top panel showed the gel of NotI digested DNA of a selected set of clones carrying the transposon; the lower panel showed the Southern blot data of the gel shown in the top panel. The probe for Southern analysis was the 411 bp sequence, one end of GS_43D16 that overlaps with GS_99I16. Note that sizes of NotI fragments II and m are same in all the clones. B, GS_43D16 clones carrying the transposon in the NotI Fragment II. The top panel showed the gel of NotI digested DNA of a selected set of clones carrying the transposon; the middle panel showed the Southern blot data of the gel shown in the top panel. The 245 bp probe for Southern analysis was obtained by PCR of the end of GS_43D16 that overlaps with GS_18J19, but not GS_99I16. The lower panel showed the distribution of clones carrying the transposon at various regions of the NotI Fragment II. One dot represented one clone containing the transposon at that particular location of the NotI Fragment H.

FIG. 23. Verification of the restriction maps of GS 43D16. A, KpnI and NotI map of the assembled GS_43D16 sequence. B, KpnI and NotI double digestion of selected GS_43D16 clones carrying the EZ::TN <NotI/KAN-3> transposon insertions. Eight fragments were expected from double digestion with both enzymes (2A). Only five fragments were observed, because some of the fragments showed to have similar mobilities in the gel. Some of these were resolved because of transposon insertions in them. We observed a close relationship between the restriction fragment sizes determined based gel electrophoresis and that based on sequence data and location of transposon insertions (Table 1). m1, □/Hind III ladders, m2, 1 kb DNA ladder (New England Biolabs Inc., Beverly, Mass.). C, SalI-NotI map of the assembled GS_43D16 sequence. D, SalI and NotI digestion of GS_43D16. Eight fragments were expected from the double digestion of GS_43D16 (FIG. 2C). Six fragments were resolved from the digestion of the clone (43 in 2D). 7.9 kb and 7.11 kb fragments were not resolved (Fragment IV, twice the intensity of either Fragment m or Fragment V) and 0.6 kb SalI-NotI fragment is not included in 2D.

FIG. 24. Arrangements of predicted genes and retrotransposons in the Rps1-k region. The green colored boxes represent full-length genes; the red colored boxes represent partial genes; the blues colored boxes represent retroelements; white boxes represent introns in the predicted genes. Boxes above the ruler represent genes that have coding sequence on the forward strand, whereas the boxes under the ruler indicate the genes that are on the reverse strand. Detail annotation data are presented in Table 2.

FIG. 25. The Rps1-k locus contains two CC-NB-LRR genes, Rps1-k-1 and Rps1-k-2. Locations of Rps1-k-1 and Rps1-k-2 on the GS_43D16 sequence are shown. Three BamHI sites involved in generation of the binary clone p43-10 carrying Rps1-k-3 (Gao et al. 2005) are shown on the map. Rps1-k-3 gene presumably originated from recombination in *E. coli*. Solid line shows the region in p43-10 and broken line indicates the region lost during the recombination process in *E. coli* and absent in p43-10. The two identical 174 bp sequences involved in the recombination process are shown by two black boxes flanking the broken line.

SEQUENCE LISTING (247 sequences)

SEQ ID NO: 1 - DNA, 3690 bp, Glycine max
  CDS (1)..(3690)
atggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacaaagagaatgggatcaaagaattgggaggactttcaaatcttcgtggtcgacttaaaattaggaacttggagaatgtttcccaaagtgatgaagcgtcggaggcaaggatgatggataaaaaacacattaatagtttatggttggaatggtctagatgtaataacaacagtaccaacttccaactagaaatagatgtgctttgcaagttacagcctcactttaacattgaatcgttgagaataaaaggctataaaggaaccagatttccagattggatgggaaattcttcctactgcaatatgatgagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatctcggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttag

SEQ ID NO: 2 - protein, 1229 aa, Glycine max
MAAALVGGAFLSAFLDVLFDRLASPDFVDLILGKKLSKKLLRKLETTLRVVGAVLDDAEKKQITNTNVKHWLNALKDAVYEADDLLDHVFTKAATQNKVRNLFSRFSDRKIVSKLEDIVVTLESHLKLKESLDLKESAVENLSWKAPSTSLEDGSHIYGREKDREAIIKLLSEDNSDGSEVSVVPIVGMGGVGKTTLAQLVYNDENLKEKFDFDFKAWVCVSQEFDVLKVTKTIIQAVTGNPCKLNDLNLLHLELMDKLKDKKFLIVLDDVWTEDYVDWSLLKKPFQCGIIRRSKILLTTRSEKTASVVQTVQTYHLNQLSNEDCWSVFANHACLSLESNENTTLEKIGKEIVKKCDGLPLAAQSLGGMLRRKHDIGDWYNILNSDIWELSESECKVIPALRLSYHYLPPHLKRCFVYCSLYPQDYEFDKNELILLWMAEDLLKKPRKGRTLEEVGHEYFDDLVSRSFFQRSSTNRSSWPYGECFVMHDLMHDLAKSLGGDFYFRSEELGKETKINTKTRHLSFTKFNSSVLDNFDVVGRAKFLRTFLSIINFEAAPFNNEEAQCIIVSKLMYLRVLSFCDFQSLDSLPDSIGKLIHLRYLDLSHSSVETLPKSLCNLYNLQTLKLCSCRKLTKLPSDMCNLVNLRHLEIRETPIEEMPRGMSKLNHLQHLDFFVVGKHKENGIKELGGLSNLRGRLKIRNLENVSQSDEASEARMMDKKHINSLWLEWSRCNNNSTNFQLEIDVLCKLQPHFNIESLRIKGYKGTRFPDWMGNSSYCNMMSLKLRDCDNCSMLPSLGQLPSLKVLKIARLNRLKTIDAGFYKNEDCRSGTPFPSLESLAIHQMPCWEVWSSFDSEAFPVLEILEIRDCPKLEGSLPNHLPALKTLTIRNCELLGSSLPTAPAIQSLEIRKSNKVALHAFPLLVETIKVEGSPMVESMMEAITNIQPTCLRSLTLRDCSSAVSFPGGRLPESLKSLYISDLKKLEFPTQHKHELLETLSIESSCDSLTSLPLVTFPNLRDLEIRNCENMESLLVSFWREGLPAPNLITFQVWGSDKLKSLPDEMSTLLPKLERLLISNCPEIESFPKRGMPPNLRIVWIFNCEKLLSSLAWPSMGMLTHLYVGGRCDGIKSFPKEGLLPPSLTYLYLSGFSNLEMLDCTGLLHLTSLQQLTIDGCPLLENMVGERLPDSLIKLTIKSCPLLKKRCRKKHPQIWPKISHIPGIKVDNRWI

SEQ ID NO: 3 - DNA, 3690 bp, Glycine max; identical to SEQ ID NO: 1
  CDS (1)..(3690)

SEQ ID NO: 4 - protein, 1229 aa, Glycine max; identical to SEQ ID NO: 2

SEQ ID NO: 5 - DNA, 3690 bp, Glycine max; identical to SEQ ID NO: 1
  CDS (1)..(3690)

SEQ ID NO: 6 - protein, 1229 aa, Glycine max; identical to SEQ ID NO: 2

SEQ ID NO: 7 - DNA, 3690 bp, Glycine max; identical to SEQ ID NO: 1
  CDS (1)..(3690)

SEQ ID NO: 8 - protein, 1229 aa, Glycine max; identical to SEQ ID NO: 2

SEQ ID NO: 9 - DNA, 3753 bp, Glycine max
  CDS (1)..(3753)
atggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttag

SEQ ID NO: 10 - protein, 1250 aa, Glycine max
MAAALVGGAFLSAFLDVLFDRLASPDFVDLILGKKLSKKLLRKLETTLRVVGAVLDDAEKKQITNTNVKHWLNALKDAVYEADDLLDHVFTKAATQNKVRNLFSRFSDRKIVSKLEDIVVTLESHLKLKESLDLKESAVENLSWKAPSTSLEDGSHIYGREKDREAIIKLLSEDNSDGSEVSVVPIVGMGGVGKTTLAQLVYNDENLKEKFDFDFKAWVCVSQEFDVLKVTKTIIQAVTGNPCKLNDLNLLHLELMDKLKDKKFLIVLDDVWTEDYVDWSLLKKPFQCGIIRRSKILLTTRSEKTASVVQTVQTYHLNQLSNEDCWSVFANHACLSLESNENTTLEKIGKEIVKKCDGLPLAAQSLGGMLRRKHDIGDWYNILNSDIWELSESECKVIPALRLSYHYLPPHLKRCFVYCSLYPQDYEFDKNELILLWMAEDLLKKPRKGRTLEEVGHEYFDDLVSRSFFQRSSTNRSSWPYGECFVMHDLMHDLAKSLGGDFYFRSEELGKETKINTKTRHLSFTKFNSSVLDNFDVVGRAKFLRTFLSIINFEAAPFNNEEAQCIIVSKLMYLRVLSFCDFQSLDSLPDSIGKLIHLRYLDLSHSSVETLPKSLCNLYNLQTLKLCSCRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPDWMGNSSYCNMISLKLRDCDNCSMLPSLGQLPSLKVLKIARLNRLKTIDAGFYKNEDCRSGTPFPSLESLAIHQMPCWEVWSSFDSEAFPVLEILEIRDCPKLEGSLPNHLPALKTLTIRNCELLGSSLPTAPAIQSLEIRKSNKVALHAFPLLVETIKVEGSPMVESMMEAITNIQPTCLRSLTLRDCSSAVSFPGGRLPESLKSLYIKDLKKLEFPTQHKHELLETLSIESSCDSLTSLPLVTFPNLRYLSIEKCENMEYLLVSGAESFKSLCYLLIYKCPNFVSFWREGLPAPNLITFQVWGSDKLKSLPDEMSTLLPKLERLLISNCPEIESFPKRGMPPNLRIVWIFNCEKLLSSLAWPSMGMLTHLYVGGRCDGIKSFPKEGLLPPSLTYLYLSGFSNLEMLDCTGLLHLTSLQQLTIDGCPLLENMVGERLPDSLIKLTIKSCPLLKKRCRKKHPQIWPKISHIPGIKVDNRWI

SEQ ID NO: 11 - DNA, 3750 bp, Glycine max
  CDS (1)..(3750)
atggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttcagtgtttggggctctgacaagttgaagtcgttgcctgatgagatgagtactcttctcccaaagttagaagatctcaccatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttag

SEQ ID NO: 12 - protein, 1249 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLATSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEICKSNKVALHAFPLLVETIEVEGSPMVESVIEAITNIQPTCLRSLTLRDCSSAVSFPGGRLPESLKSLSIKDLKKLEFPTQHKHELLETLSIESSCDSLTSLPLVTFPNLRYLSIEKCENMEYLLVSGAESFKSLCYLLIYKCPNFVSFWREGLPAPNLITFSVWGSDKLKSLPDEMSTLLPKLEDLTISNCPEIESFPKRGMPPNLRRVEIVNCEKLLSGLAWPSMGMLTHLNVGGPCDGIKSFPKEGLLPPSLTSLSLYDLSNLEMLDCTGLLHLTSLQQLQIFGCPKLENMAGESLPFSLIKLTMVECPLLEKRCRMKHPQIWPKVSHIPGIKVGNRWI

SEQ ID NO: 13 - DNA, 3750 bp, Glycine max; identical to SEQ ID NO: 11
  CDS (1)..(3750)

SEQ ID NO: 14 - protein, 1249 aa, Glycine max; identical to SEQ ID NO: 12

SEQ ID NO: 15 - DNA, 3687 bp, Glycine max
  CDS (1)..(3687)
atggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttag

SEQ ID NO: 16 - protein, 1228 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLATSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEICKSNKVALHAFPLLVETIEVEGSPMVESVIEAITNIQPTCLRSLTLRDCSSAVSFPGGRLPESLKSLSIKDLKKLEFPTQHKHELLETLSIESSCDSLTSLPLVTFPNLRDLEIRNCENMESLLVSFWREGLPAPNLITFQVWGSDKLKSLPDEMSTLLPKLERLLISNCPEIESFPKRGMPPNLRRVEIVNCEKLLSGLAWPSMGMLTHLNVGGPCDGIKSFPKEGLLPPSLTSLSLYDLSNLEMLDCTGLLHLTSLQQLQIFGCPKLENMAGESLPFSLIKLTMVECPLLEKRCRMKHPQIWPKVSHIPGIKVGNRWI

SEQ ID NO: 17 - DNA, 3750 bp, Glycine max
  CDS (1)..(3750)
atggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccaaatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacgaagagaatggaatcaaagaattgggaggactttcaaatcttcgtggtcggcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttag

SEQ ID NO: 18 - protein, 1249 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLAKSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCRKLTKLPSDMCNLVNLRHLEIRETPIEEMPRGMSKLNHLQHLDFFVVGKHEENGIKELGGLSNLRGRLEIRKLENVSQSDEALEARMMDKKHINSLQLEWSGCNNNSTNFQLEIDVLCKLQPHFNIESLEIKGYEGTRFPDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEICKSNKVALHAFPLLVETIEVEGSPMVESVIEAITNIQPTCLRSLTLRDCSSAVSFPGGRLPESLKSLSIKDLKKLEFPTQHKHELLETLSIESSCDSLTSLPLVTFPNLRYLSIEKCENMEYLLVSGAESFKSLCYLLIYKCPNFVSFWREGLPAPNLITFQVWGSDKLKSLPDEMSTLLPKLERLLISNCPEIESFPKRGMPPNLRIVWIFNCEKLLSSLAWPSMGMLTHLYVGGRCDGIKSFPKEGLLPPSLTYLYLSGFSNLEMLDCTGLLHLTSLQQLTIDGCPLLENMVGERLPDSLIKLTIKSCPLLKKRCRKKHPQIWPKISHIPGIKVDNRWI

SEQ ID NO: 19 - DNA, 20 bp, Glycine max
cagctgccagaaacccacgt

SEQ ID NO: 20 - DNA, 20 bp, Glycine max
ctgcaccatcgtcaaccact

SEQ ID NO: 21 - DNA, 23 bp, Glycine max
ctaacaattgttacctctcttgc

SEQ ID NO: 22 - DNA, 18 bp, Glycine max
ctattgtgaggatgggtg

SEQ ID NO: 23 - DNA, 18 bp, Glycine max
cacccatcctcacaatag

SEQ ID NO: 24 - DNA, 24 bp, Glycine max
gggcatgggtgatgttggaaaaac

SEQ ID NO: 25 - DNA, 24 bp, Glycine max
gtttttccaacatcacccatgccc

SEQ ID NO: 26 - DNA, 24 bp, Glycine max
catgggtggggttagaaaaactac

SEQ ID NO: 27 - DNA, 24 bp, Glycine max
gtagtttttctaaccccacccatg

SEQ ID NO: 28 - DNA, 24 bp, Glycine max
catgggtggggttgagaaaactac

SEQ ID NO: 29 - DNA, 24 bp, Glycine max
gtagttttctcaaccccacccatg

SEQ ID NO: 30 - DNA, 24 bp, Glycine max
cagatatttgattctgattttaag

SEQ ID NO: 31 - DNA, 24 bp, Glycine max
cttaaaatcagaatcaaatatctg

SEQ ID NO: 32 - DNA, 23 bp, Glycine max
taaggcatgcgtttgtgtttctc

SEQ ID NO: 33 - DNA, 23 bp, Glycine max
gagaaacacaaacgcatgcctta

SEQ ID NO: 34 - DNA, 21 bp, Glycine max
catgggtttgtgcttctcaag

SEQ ID NO: 35 - DNA, 21 bp, Glycine max
cttgagaagcacaaacccatg

SEQ ID NO: 36 - DNA, 23 bp, Glycine max
ggtttgtgttcctcaagaatttg

SEQ ID NO: 37 - DNA, 23 bp, Glycine max
caaattcttgaggaacacaaacc

SEQ ID NO: 38 - DNA, 25 bp, Glycine max
cttaattgttttggctgatgtttgg

SEQ ID NO: 39 - DNA, 25 bp, Glycine max
ccaaacatcagccaaaacaattaag

SEQ ID NO: 40 - DNA, 22 bp, Glycine max
gttttggatggagtttggacag

SEQ ID NO: 41 - DNA, 22 bp, Glycine max
ctgtccaaactccatccaaaac

SEQ ID NO: 42 - DNA, 19 bp, Glycine max
cttctaacaatccgcagtg

SEQ ID NO: 43 - DNA, 19 bp, Glycine max
cactgcggattgttagaag

SEQ ID NO: 44 - DNA, 24 bp, Glycine max
gcagcagagttccttggaggcatg

SEQ ID NO: 45 - DNA, 24 bp, Glycine max
catgcctccaaggaactctgctgt

SEQ ID NO: 46 - DNA, 23 bp, Glycine max
cagagtcgcttagaggcatgttg

SEQ ID NO: 47 - DNA, 23 bp, Glycine max
caacatgcctctaagcgactctg

SEQ ID NO: 48 - DNA, 28 bp, Glycine max
catgacattggtaagtggaataatattc

SEQ ID NO: 49 - DNA, 28 bp, Glycine max
gaatattattccacttaccaatgtcatg

SEQ ID NO: 50 - DNA, 21 bp, Glycine max
gttatcattatttccctccac

SEQ ID NO: 51 - DNA, 21 bp, Glycine max
gtggagggaaataatgataac

SEQ ID NO: 52 - DNA, 29 bp, Glycine max
catttaaaacgatgctctgtttattgttc

SEQ ID NO: 53 - DNA, 29 bp, Glycine max
gaacaataaacagagcatcgttttaaatg

SEQ ID NO: 54 - DNA, 29 bp, Glycine max
catttaaaacgatgccttgtttattgttc

SEQ ID NO: 55 - DNA, 29 bp, Glycine max
gaacaataaacaaggcatcgttttaaatg

SEQ ID NO: 56 - DNA, 25 bp, Glycine max
caaatgttttgtggtgcatgacctc

SEQ ID NO: 57 - DNA, 25 bp, Glycine max
gaggtcatgcaccacaaaacatttg

SEQ ID NO: 58 - DNA, 25 bp, Glycine max
gtgatgcatggtctcatgcatgatc

SEQ ID NO: 59 - DNA, 25 bp, Glycine max
gatcatgcatgagaccatgcatcac

SEQ ID NO: 60 - protein, 478 aa, Glycine max
FDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLATS

SEQ ID NO: 61 - protein, 479 aa, Glycine max
FDRLASPDFVDLILGKKLSKKLLRKLETTLRVVGAVLDDAEKKQITNTNVKHWLNALKDAVYEADDLLDHVFTKAATQNKVRNLFSRFSDRKIVSKLEDIVVTLESHLKLKESLDLKESAVENLSWKAPSTSLEDGSHIYGREKDREAIIKLLSEDNSDGSEVSVVPIVGMGGVGKTTLAQLVYNDENLKEKFDFDFKAWVCVSQEFDVLKVTKTIIQAVTGNPCKLNDLNLLHLELMDKLKDKKFLIVLDDVWTEDYVDWSLLKKPFQCGIIRRSKILLTTRSEKTASVVQTVQTYHLNQLSNEDCWSVFANHACLSLESNENTTLEKIGKEIVKKCDGLPLAAQSLGGMLRRKHDIGDWYNILNSDIWELSESECKVIPALRLSYHYLPPHLKRCFVYCSLYPQDYEFDKNELILLWMAEDLLKKPRKGRTLEEVGHEYFDDLVSRSFFQRSSTNRSSWPYGECFVMHDLMHDLAKS

SEQ ID NO: 62 - protein, 454 aa, Glycine max
FDRLAPNGDLLNMFRKHKDHVKLLKKLKMTLRGIQIVLSDAENKQASNPSVRDWLNELRDAVDSAENLIEEVNYEALRLKVEGQHQNFSETSNQQVSDEFFLNIKDKLEDTIETLKDLQEQIGLLGLKEYFDSTKLETRTPSTSLIDEPDIFGRQSEIEDLIDRLLSEGASGKNLTVVPIVGMGGLGKTTLAKAVYNDESVKNHFDLKAWFCVSEAYNAFRITKGLLQEIGSIDLVDDNLNQLQVKLKERLKEKKFLIVLDDVWNDNYNEWDELRNVFVQGDIGSKIIVTTRKDSVALMMGNEQISMGNLSTEASWSLFQRHAFENMDPMGHSELEEVGRQIAAKCKGLPLALKTLAGMLRSKSEVEEWKCILRSEIWELRDNDILPALMLSYNDLPAHLKRCFSFCAIFPKDYPFRKEQVIHLWIANGLVPVEDEIIQDLGNQFFLELSSRSL

SEQ ID NO: 63 - protein, 489 aa, Glycine max
FDRLAPNGDLLNMFRKHTDDVELFEKLGDILLSLQIVLSDAENKKASNQFVSQWLHKLQTAVDAAENLIEQVNYEALRLKVETSNQQVSDLNLCLSDDFFLNIKKKLEDTIKKLEVLEKQIGRLGLKEHFISTKQETRTPSTSLVDDSGIFGRKNEIENLVGRLLSMDTKRKNLAVVPIVGMGGMGKTTLAKAVYNDERVQKHFGLTAWFCVSEAYDAFRITKGLLQEIGSTDLKADDNLNQLQVKLKADDNLNQLQVKLKEKLNGKRFLVVLDDVWNDNYPEWDDLRNLFLQGDIGSKIIVTTRKESVALMMDSGAIYMGILSSEDSWALFKRHSLEHKDPKEHPEFEEVGKQIADKCKGLPLALKALAGMLRSKSEVDEWRNILRSEIWELPSCSNGILPALMLSYNDLPAHLKQCFAYCAIYPKDYQFRKEQVIHLWIANGLVHQFHSGNQYFIELRSRSLFEMASEPSERDVEEFLMHDLVNDLA

SEQ ID NO: 64 - protein, 450 aa, Glycine max
MAYAAVTSLMRTIHQSMELTGCDLQPFYEKLKSLRAILEKSCNIMGDHEGLTILEVEIVEVAYTTEDMVDSESRNVFLAQNLEERSRAMWEIFFVLEQALECIDSTVKQWMATSDSMKDLKPQTSSLVSLPEHDVEQPENIMVGRENEFEMMLDQLARGGRELEVVSIVGMGGIGKTTLATKLYSDPCIMSRFDIRAKATVSQEYCVRNVLLGLLSLTSDEPDDQLADRLQKHLKGRRYLVVIDDIWTTEAWDDIKLCFPDCYNGSRILLTTRNVEVAEYASSGKPPHHMRLMNFDESWNLLHKKIFEKEGSYSPEFENIGKQIALKCGGLPLAITVIAGLLSKMGQRLDEWQRIGENVSSVVSTDPEAQCMRVLALSYHHLPSHLKPCFLYFAIFTEDEQISVNELVELWPVEGFLNEEEGKSIEEVATTCINELIDRSLIFIHNFSFR

SEQ ID NO: 65 - DNA, 26 bp, Glycine max
caagtggattgatgtgatatctccac

SEQ ID NO: 66 - DNA, 34 bp, Glycine max
cgggatcccgttcgtaaatggtgaaaattttcag

SEQ ID NO: 67 - DNA, 29 bp, Glycine max
cgcggatcctctcaacaatctagctagag

SEQ ID NO: 68 - DNA, 40 bp, Glycine max
cgaatgagctcccgggaggcctaagacgtgctcaaatcac

SEQ ID NO: 69 - protein, 11 aa, Glycine max
CCNBSLRRARC

SEQ ID NO: 70 - DNA, 1056 bp, Glycine max
  CDS (1)..(1056)
aaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatca

SEQ ID NO: 71 - protein, 352 aa, Glycine max
KAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLATS

SEQ ID NO: 72 - DNA, 18 bp, Glycine max
ctattgtgaggatgggtg

SEQ ID NO: 73 - DNA, 18 bp, Glycine max
cacccatcctcacaatag

SEQ ID NO: 74 - DNA, 24 bp, Glycine max
catgggtggggttgagaaaactac

SEQ ID NO: 75 - DNA, 24 bp, Glycine max
gtagttttctcaaccccacccatg

SEQ ID NO: 76 - DNA, 24 bp, Glycine max
cagatatttgattctgattttaag

SEQ ID NO: 77 - DNA, 24 bp, Glycine max
cttaaaatcagaatcaaatatctg

SEQ ID NO: 78 - DNA, 23 bp, Glycine max
taaggcatgcgtttgtgtttctc

SEQ ID NO: 79 - DNA, 23 bp, Glycine max
gagaaacacaaacgcatgcctta

SEQ ID NO: 80 - DNA, 21 bp, Glycine max
catgggtttgtgcttctcaag

SEQ ID NO: 81 - DNA, 21 bp, Glycine max
cttgagaagcacaaacccatg

SEQ ID NO: 82 - DNA, 23 bp, Glycine max
ggtttgtgttcctcaagaatttg

SEQ ID NO: 83 - DNA, 23 bp, Glycine max
caaattcttgaggaacacaaacc

SEQ ID NO: 84 - DNA, 25 bp, Glycine max
cttaattgttttggctgatgtttgg

SEQ ID NO: 85 - DNA, 25 bp, Glycine max
ccaaacatcagccaaaacaattaag

SEQ ID NO: 86 - DNA, 22 bp, Glycine max
gttttggatggagtttggacag

SEQ ID NO: 87 - DNA, 22 bp, Glycine max
ctgtccaaactccatccaaaac

SEQ ID NO: 88 - DNA, 24 bp, Glycine max
gcagcagagttccttggaggcatg

SEQ ID NO: 89 - DNA, 24 bp, Glycine max
catgcctccaaggaactctgctgt

SEQ ID NO: 90 - DNA, 28 bp, Glycine max
catgacattggtaagtggaataatattc

SEQ ID NO: 91 - DNA, 28 bp, Glycine max
gaatattattccacttaccaatgtcatg

SEQ ID NO: 92 - DNA, 21 bp, Glycine max
gttatcattatttccctccac

SEQ ID NO: 93 - DNA, 21 bp, Glycine max
gtggagggaaataatgataac

SEQ ID NO: 94 - DNA, 29 bp, Glycine max
catttaaaacgatgctctgtttattgttc

SEQ ID NO: 95 - DNA, 29 bp, Glycine max
gaacaataaacagagcatcgttttaaatg

SEQ ID NO: 96 - DNA, 25 bp, Glycine max
caaatgttttgtggtgcatgacctc

SEQ ID NO: 97 - DNA, 25 bp, Glycine max
gaggtcatgcaccacaaaacatttg

SEQ ID NO: 98 - DNA, 25 bp, Glycine max
gtgatgcatggtctcatgcatgatc

SEQ ID NO: 99 - DNA, 25 bp, Glycine max
gatcatgcatgagaccatgcatcac

SEQ ID NO: 100 - DNA, 24 bp, Glycine max
catgggtggggttggaaaaactac

SEQ ID NO: 101 - DNA, 24 bp, Glycine max
gtagtttttccaaccccacccatg

SEQ ID NO: 102 - DNA, 21 bp, Soybean
catgggtttgtgtttctcaag

SEQ ID NO: 103 - DNA, 21 bp, Glycine max
cttgagaaacacaaacccatg

SEQ ID NO: 104 - DNA, 25 bp, Glycine max
cttaattgttttggatgatgtttgg

SEQ ID NO: 105 - DNA, 25 bp, Glycine max
ccaaacatcatccaaaacaattaag

SEQ ID NO: 106 - DNA, 21 bp, Glycine max
gttatcattatctccctccac

SEQ ID NO: 107 - DNA, 21 bp, Glycine max
gtggagggagataatgataac

SEQ ID NO: 108 - DNA, 29 bp, Glycine max
catttaaaacgatgctttgtttattgttc

SEQ ID NO: 109 - DNA, 29 bp, Glycine max
gaacaataaacaaagcatcgttttaaatg

SEQ ID NO: 110 - protein, 32 aa, Glycine max
MAAALVGGAFLSAFLDVVFDRLASPEFVDLIR

SEQ ID NO: 111 - protein, 112 aa, Glycine max
GKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSW

SEQ ID NO: 112 - protein, 352 aa, Glycine max; identical to SEQ ID NO: 71

SEQ ID NO: 113 - protein, 75 aa, Glycine max
LGGDFYFRSEELGKETKINTKTRHLSFAKFNSSVLDNFDVIGRAKFLRTFLSIINFEAAPFNNEEAQCIIMSKLM

SEQ ID NO: 114 - protein, 24 aa, Glycine max
YLRVLSFCDFQSLDSLPDSIGKLI

SEQ ID NO: 115 - protein, 23 aa, Glycine max
HLRYLDLSFSRIETLPKSLCNLY

SEQ ID NO: 116 - protein, 24 aa, Glycine max
NLQTLKLCSCRKLTKLPSDMRNLV

SEQ ID NO: 117 - protein, 23 aa, Glycine max
NLRHLGIAYTPIKEMPRGMGKLN

SEQ ID NO: 118 - protein, 25 aa, Glycine max
HLQHLDFFVVGKHEENGIKELGGLS

SEQ ID NO: 119 - protein, 29 aa, Glycine max
NLRGQLEIRKLENVSQSDEALEARMMDKK

SEQ ID NO: 120 - protein, 33 aa, Glycine max
HINSLQLEWSGCNNNSTNFQLEIDVLCKLQPHF

SEQ ID NO: 121 - protein, 25 aa, Glycine max
NIESLEIKGYEGTRFPDWMGNSSYC

SEQ ID NO: 122 - protein, 23 aa, Glycine max
NMISLKLRDCHNCSMLPSLGQLP

SEQ ID NO: 123 - protein, 33 aa, Glycine max
SLKDLGIARLNRLKTIDAGFYKNEECRSGTSFP

SEQ ID NO: 124 - protein, 25 aa, Glycine max
SLESLSIDDMPCWEVWSSFDSEAFP

SEQ ID NO: 125 - protein, 22 aa, Glycine max
VLNSLEIRDCPKLEGSLPNHLP

SEQ ID NO: 126 - protein, 21 aa, Glycine max
ALTKLVIRNCELLVSSLPTAP

SEQ ID NO: 127 - protein, 20 aa, Glycine max
AIQSLEICKSNKVALHAFPL

SEQ ID NO: 128 - protein, 26 aa, Glycine max
LVETIEVEGSPMVESVIEAITNIQPT

SEQ ID NO: 129 - protein, 23 aa, Glycine max
CLRSLTLRDCSSAVSFPGGRLPE

SEQ ID NO: 130 - protein, 22 aa, Glycine max
SLKSLSIKDLKKLEFPTQHKHE

SEQ ID NO: 131 - protein, 23 aa, Glycine max
LLETLSIESSCDSLTSLPLVTFP

SEQ ID NO: 132 - protein, 28 aa, Glycine max
NLRDLEIRNCENMESLLVSFWREGLPAP

SEQ ID NO: 133 - protein, 25 aa, Glycine max
NLITFQVWGSDKLKSLPDEMSTLLP

SEQ ID NO: 134 - protein, 23 aa, Glycine max
KLERLLISNCPEIESFPKRGMPP

SEQ ID NO: 135 - protein, 23 aa, Glycine max
NLRRVEIVNCEKLLSGLAWPSMG

SEQ ID NO: 136 - protein, 25 aa, Glycine max
MLTHLNVGGPCDGIKSFPKEGLLPP

SEQ ID NO: 137 - protein, 25 aa, Glycine max
SLTSLSLYDLSNLEMLDCTGLLHLT

SEQ ID NO: 138 - protein, 23 aa, Glycine max
SLQQLQIFGCPKLENMAGESLPF

SEQ ID NO: 139 - protein, 23 aa, Glycine max
SLIKLTMVECPLLEKRCRMKHPQ

SEQ ID NO: 140 - protein, 7 aa, Glycine max
  misc_feature (1)..(2): Xaa can be any naturally occurring amino acid
  misc_feature (4)..(4): Xaa can be any naturally occurring amino acid
  misc_feature (6)..(7): Xaa can be any naturally occurring amino acid
XXLXLXX

SEQ ID NO: 141 - protein, 25 aa, Glycine max
NLRYLSIEKCENMEYLLVSGAESFK

SEQ ID NO: 142 - protein, 24 aa, Glycine max
SLCYLLIYKCPNFVSFWREGLPAP

SEQ ID NO: 143 - protein, 25 aa, Glycine max
NLITFSVWGSDKLKSLPDEMSTLLP

SEQ ID NO: 144 - protein, 23 aa, Glycine max
KLEDLTISNCPEIESFPKRGMPP

SEQ ID NO: 145 - protein, 18 aa, Glycine max
IWPKVSHIPGIKVGNRWI

SEQ ID NO: 146 - DNA, 36 bp, Glycine max
ctatataataaaaaaataaaaataaaaaagaccata

SEQ ID NO: 147 - DNA, 9 bp, Glycine max
tcgtcctgc

SEQ ID NO: 148 - DNA, 196 bp, Glycine max
ttccctgcgaccagttgagcttccacatgccgagttggtccgtggctatatagaatgtgatagtctgttcatgattagacggagacaggaacctgataagcaggtaagtctcgccagatacacatgcaagactatcgtgaaagcccaagcgctgttgtatggaaaggacaccagactttatgggaaaaagtagaaa

SEQ ID NO: 149 - DNA, 168 bp, Glycine max
actgggaacgaataacctcggggtcaccaattcaactgcaacggtacaaagacccaccgactaaccttaagccgttgcttagtgttatttgttaatttacaaatgccccaactttgtagttgaaccggaggacacctaacgcaattttaaagcttttggtgaagctgg

SEQ ID NO: 150 - DNA, 79 bp, Glycine max
gctacatactgctttatctgaaatatatcagtaaaaattttagcctaagaactgagtatagataactcgtgtagtcgaa

SEQ ID NO: 151 - DNA, 60 bp, Glycine max
tgcgtcaactcctaaaaggcactattttaggcctcagacgcgagccgggacacgccgagg

SEQ ID NO: 152 - DNA, 64 bp, Glycine max
tacgtgcgtcaactcctaaaaggcactattttaggcctcagacgcgagccgggacacgccgagg

SEQ ID NO: 153 - DNA, 595 bp, Glycine max
tctaataaaattaaccatggtggaatgtcctttgctggaaaaacgatgccgcatgaagcaccctcaaatttggcctaaagtttcccacatccctggcattaaggttggcaatagatggatttagccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaattt

SEQ ID NO: 154 - DNA, 595 bp, Glycine max
tctaataaaattaaccataaagagttgtcctttgctgaaaaaacgatgccggaagaagcaccctcaaatttggcctaaaatttcccacatccctggcattaaggttgacaatagatggatttagccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaattt

SEQ ID NO: 155 - DNA, 301 bp, Glycine max
tctaataaaattaacaataaagagatgtcctttgctggaaaaacgatgccggaagaagcaccctcaaatttggcctaaaatttcccacatccctggcattcaggttgatgatagatggatttagccaccaaggatgaccaacagagaatcaacaaatcatcaaaggcaacgtggaaattgaccttgtatatatgtttcgaagaagtaacgaaacagatatggttgattgacccggagaaactgtacctacccatgaatctaagttcaaatttgaactagtgctaaatgtaacttttaattt

SEQ ID NO: 156 - DNA, 301 bp, Glycine max
tctaataaaattaaccatagtgagttgtcctttgctggaaatacgatgccgcatgaagcaccctcaaatttggcctaaaatttcccacatccctggcattcaggttgacgatagatggatttagccaccaaggatgaccaacagagaatcaacaaatcatcaaaggcaacgtggaaattgaccttgtatatatgtttcgaagaagtaacgatacagatatggttgattggcccggagaaattgtacctacccatgaatctaagttcaaatttgaactagtgctaaatgtaacttttaattt

SEQ ID NO: 157 - DNA, 301 bp, Glycine max
tctaataaaattaaccatatgggaatgtcctttgctggaaaaacgatgccgcatgaagcaccctcaaatttggcctaaaatttcccacatccctggcattaaggttgacgatagatggatttagccaccaaggatgatcatcagagaatcaacaaatcatcaaaggcaacgtggaaattgaccttgtatatatgtttagaagaagtaacgatacagatatggttgattggcccggagaaactgtacctatccatgaatctaagttcaaatttgaactagtgctaaatgtaacttttgattt

SEQ ID NO: 158 - DNA, 420 bp, Glycine max
tctaataaaattaaccatattggaatgtcctttgctggaaaaacaatgccgcatgaagcaccctcaaatttaatctggcctaaaatttgccacatccctggcattcaggttgacgatagatggatttagccaccaaggatgaccaacagagaatcaacaaattatcaaaggcaacttgtgatatcatctaaatcaaattcactgaagagtgccgcttaacccctagcttcgaagaagtaacgatacaggtactaagtaacaacattgataaatacttaaatataatgatacaggtactaagtaacaacattgataaacttatttttgtttttcagatatggttgattggtccgaagaaactgtacctacccatgaatctaagtttaaatttgaactagtgctaaatgtaacttttgattt

SEQ ID NO: 159 - DNA, 912 bp, Glycine max
tcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatcttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagata

SEQ ID NO: 160 - DNA, 2199 bp, Glycine max
ccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttgtccgattaagaggagtttatagagtagattaaattggttttgaaaaagagaaatatcatcttatacaatttttggttttcttaattcattgttcaattgatgtagtttaaaatttaaatatgatttaataagtttggattgatctcga

SEQ ID NO: 161 - DNA, 569 bp, Glycine max
tttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagata

SEQ ID NO: 162 - DNA, 2198 bp, Glycine max
ccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcataatggaat

SEQ ID NO: 163 - DNA, 1309 bp, Glycine max
acttctctctgcaagctaaaaaggagtgttgtttaggaaacaattttgaggcaggtgtattttggaaaaaatgaggagagagcaagtgtagtggagtaaaaaaatcctgtaaggttttgtttggtagtaaaaagaaaaaaataattgtaatgagaaaaaataagttagaggataaatatcttcaacacttaaacaaacaaataaaaaagtttttctaggaagttcacttaaatctattttaactattgataaaaatttatacctgttgatttaaaataaaattatatttattaaatatgataggagaaaaaatattttttacatatagtaaaatattttcatttgctgaacttaaattttctttatctctcattttactattgttgtttgagatgatctcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagata

SEQ ID NO: 164 - DNA, 2143 bp, Glycine max
ccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtag

SEQ ID NO: 165 - DNA, 1718 bp, Glycine max
acttctctctgcaagctaaaaaggagtgttgtttaggaaacaattttgaggcaggtgtattttgaaaaaaattgaggagagagcaagtgtagtggagtaaaaaaatcctataagattttgtttgatactaaaaagaaaaaaataattgtgatgagaaaaaataagttagaggataaatatcttcaacacttaaacaaacaaataaaaaagtttttctagaaagttcacttaaatctattttcactattgataaaaatttatacctgttgatttaaaataaaattatattttataaaaattatatttattaaatatgataggagaaaaatattttttacatatagtaaaatattttcatttgctggacttaaattttctttatctctcattttagtattgttgtttgagatgatctcactaaatatattttacttgactaataataaaaattttatatagataagattcaaaggataatcaccaaccaaaaatttttatggaagtatttatcaaataattacaatagatatataacataaaaaaagagttgaattgaataataatttttcatgccaaattactttaatcactctatattattattattattatcattattataacatcttcacaatattctttattttattagtatctattatttattttattaattttatttaataaaaaatcacaaacttttctttttgcacacatctttaacgtacatataaagatattcaaatcttgaattcattaatattatgtttttagggatcaattagcatgtgtcctttctttaattctttctcttttaatttgttcaacattttttttgtcttaataattttttaatctcatttttttattttcctcctaacaaaatttattctatatataagaattaataaaaatttaaatcttttaccacttgattaaaaaacataaatcattatcaattattttaaatttataaaatcatgattcagtattagatctttataaaataccatatctctatgacaattttaatgattaggttgaaatataaactaacacgaatttaagtaaatatttcactatttactttcacattgaaaaattgattttaaattttaactttagaaaaaaaattctaagttgaggatctttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagata

SEQ ID NO: 166 - DNA, 2191 bp, Glycine max
ccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcat

SEQ ID NO: 167 - DNA, 1246 bp, Glycine max
acttctctctgcaagctaaaaaggagtgttgtttaggaaacaattttgaggcaggtgtattttggaaaaaatgaggagagagcaagtgtagtggagtaaaaaaatcctgtaaggttttgtttggtagtaaaaagaaaaaaataattgtaatgagaaaaaataagttagaggataaatatcttcaacacttaaacaaacaaataaaaaagtttttctaggaagttcacttaaatctattttaactattgataaaaatttatacctgttgatttaaaataaaattatatttattaaatatgataggagaaaaaatattttttacatatagtaaaatattttcatttgctgaacttaaattttctttatctctcattttactattgttgtttgagatgatctcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcag

SEQ ID NO: 168 - DNA, 2199 bp, Glycine max
ccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttggccgattaagaggagtttatagagtagattaaattggttttgaaaaagagaaatatcatcttatacaatttttggttttcttaattcattgttcaattgatgtagtttaaaatttaaatatgatttaataagtttggattgatctcga

SEQ ID NO: 169 - protein, 1229 aa, Glycine max; identical to SEQ ID NO: 2

SEQ ID NO: 170 - protein, 1229 aa, Glycine max; identical to SEQ ID NO: 2

SEQ ID NO: 171 - protein, 1229 aa, Glycine max
MAAALVGGAFLSAFLDVLFDRLASPDFVDLILGKKLSKKLLRKLETTLRVVGAVLDDAEKKQITNTNVKHWLNALKDAVYEADDLLDHVFTKAATQNKVRNLFSRFSDRKIVSKLEDIVVTLESHLKLKESLDLKESAVENLSWKAPSTSLEDGSHIYGREKDREAIIKLLSEDNSDGSEVSVVPIVGMGGVGKTTLAQLVYNDENLKEKFDFDFKAWVCVSQEFDVLKVTKTIIQAVTGNPCKLNDLNLLHLELMDKLKDKKFLIVLDDVWTEDYVDWSLLKKPFQCGIIRRSKILLTTRSEKTASVVQTVQTYHLNQLSNEDCWSVFANHACLSLESNENTTLEKIGKEIVKKCDGLPLAAQSLGGMLRRKHDIGDWYNILNSDIWELSESECKVIPALRLSYHYLPPHLKRCFVYCSLYPQDYEFDKNELILLWMAEDLLKKPRKGRTLEEVGHEYFDDLVSRSFFQRSSTNRSSWPYGECFVMHDRNLENVSQSDEASEARMMDKKHINSLWLEWSRCNNNSTNFQLEIDVLCKLQPHFNIESLRIKGYKGTRFPLMHDLAKSLGGDFYFRSEELGKETKINTKTRHLSFTKFNSSVLDNFDVVGRAKFLRTFLSIINFEAAPFNNEEAQCIIVSKLMYLRVLSFCDFQSLDSLPDSIGKLIHLRYLDLSHSSVETLPKSLCNLYNLQTLKLCSCRKLTKLPSDMCNLVNLRHLEIRETPIEEMPRGMSKLNHLQHLDFFVVGKHKENGIKELGGLSNLRGRLKIDWMGNSSYCNMMSLKLRDCDNCSMLPSLGQLPSLKVLKIARLNRLKTIDAGFYKNEDCRSGTPFPSLESLAIHQMPCWEVWSSFDSEAFPVLEILEIRDCPKLEGSLPNHLPALKTLTIRNCELLGSSLPTAPAIQSLEIRKSNKVALHAFPLLVETIKVEGSPMVESMMEAITNIQPTCLRSLTLRDCSSAVSFPGGRLPESLKSLYISDLKKLEFPTQHKHELLETLSIESSCDSLTSLPLVTFPNLRDLEIRNCENMESLLVSFWREGLPAPNLITFQVWGSDKLKSLPDEMSTLLPKLERLLISNCPEIESFPKRGMPPNLRIVWIFNCEKLLSSLAWPSMGMLTHLYVGGRCDGIKSFPKEGLLPPSLTYLYLSGFSNLEMLDCTGLLHLTSLQQLTIDGCPLLENMVGERLPDSLIKLTIKSCPLLKKRCRKKHPQIWPKISHIPGIKVDNRWI

SEQ ID NO: 172 - protein, 1109 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPLMHDLATSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEICKSNKVALHAFPLLVETIEVEGSPMVESVIEAITNIQPTCLRSLTLRDCSSAVSFPGGRLPESLKSLSIKDLKKLEFPTQHKHELLETLSIESSCDSLTSLPLVTFPNLRYLSIEKCENMEYLLVSGAESFKSLCYLLIYQLQIFGCPKLENMAGESLPFSLIKLTMVECPLLEKRCRMKHPQIWPKVSHIPGIKVGNRWI

SEQ ID NO: 173 - protein, 1109 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPLMHDLATSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEIDLKKLEFPTQHKHELLETLSIESSCDSLTSLPLVTFPNLRYLSIEKCENMEYLLVSGAESFKSLCYLLIYCKSNKVALHAFPLLVETIEVEGSPMVESVIEAITNIQPTCLRSLTLRDCSSAVSFPGGRLPESLKSLSIKQLQIFGCPKLENMAGESLPFSLIKLTMVECPLLEKRCRMKHPQIWPKVSHIPGIKVGNRWI

SEQ ID NO: 174 - DNA, 38533 bp, Glycine max
atttaggtgacactatagaatactcaagcttgcataattcatcaaggtatcaatatccactcccaaggcaccacaaaagccttgatggaaattcattttgaggcccgagacaagttcaaagcctctcaaaatgctttttatggtaagcaccttagaaatggttgcttctcctgtaaagagtgcgtcaagcgtcatttgcatattgaagcaagtttacttcctctctcccactacccactaagaaattagagaatttgttcctttcaagtgcttgcctcgtgtttttatgagacaattcatcatcataatataatctcaaaataatatctattccttatcaaaaaaggatactaccaagatacttacaaaattaacatttaaatgttgaaaattgtctcatataagataatatatattaataatgattgccaacaaataagtagcatgaagtacattaagaagaaaaaaatcccttctttttattcaattttttttctcgttctagcgactaaatattttatatcaaagcgtcttgaattagacaacattgttttcaaagaaaatgaagtttgggagaatatgttgagtttaattagtggaggtacttcacaaaaattttagaaggaaggtaattgtttagacatttttgttaatgggagcgaggaaatctttggaggtgatgatcccctctcaatttccgaataaataaccgaagaacaattaaaactatagaaaaatatcaagattccttaaggaagaatccataaatattaaatgatcactgaaataaatcaaataaaaaaaagttgaaggacgaaagtgaaaccaagccttacattaaaagataaaaatattacttttaccttcatgaattttatataaatcttatttagtaaataaagtttaatattttgtaaaaaaaaaatcatataaaatggattcaacaataatgtaaaaacaaaaaaatattagatattctttaaataataaggtacttcggtttgtagaacacattctcaagtttaaagagcttcaacccgacctttgaaacaattaacctagggttagctcgatttggtttaagccagacttgatttaactaagaaattcaaaccgaactaattggtttggttccgataagcaaaacaatatagctttaaatagggtttgtctaactaaacctaagtaaaaatttcactgaaaaattcaaacttgcttcttatgatttttaatgaaattcaaataacattctagaaaatatgtagcgtaaacatggcaggagataggtaagtacaggaatatgttgggtcgttcacagcaggaacttgagccactgatacaactattgaggaagagcaaagaggttgtttacaagtgttcaaaaatagggaaatacaattttgtggctaagaattcttaccgtggaaaactaaaattaaagatcttgcagactcaattgagaggtttttcaatattgaaatgccagctcttattgcacgcgatcaacttgagatcttgcttagggttagtgaaatagaatacttcaatgatgaaaagttttccgattcggtgatcgcgccattagctatagctgctgctgttactgttgctatagttattaaatgtcttctgttctaattttttcatgattaattagggatatttggatagtctggataaggttttagtttcaaactttattgtctttattgtatataagcaaccgatttgtcacgcctattatgtttttgcttttttattgtactttcgcatttctattaagctaattaaagatgttatatatatagttaaaaaattctttcatatgtttttaaatgcatgtttatctttagaattttctttacttcttatactctactatttatgataatatatagtaattcaattttattttgtatattgcatgtaggctaccgtattttttttccaacaaaatgatttgtattaaatggtaccaaaattacctaagatccaaaaacatatacaccagtgacagtagaaagaaagatagctagcttcgaacatggaccattacacccaaagtcatggttttaaaatgtagtcagcaaccataattgcagtcataacgctaatgtattttgactctgtaatcacatcacaattataattatgatcacatcagtttgtatttttccataattatccacaatgtaagatttttaggttcgttgcatgcaacgcaatcataattgcaatttaaaatcatgtctaaagccatgcaacattgatgcggcatcactaaccagcccccaccatcgtgcacataaacatcggttgcatttgggatgatcccactcgaagagcagctaccaccgaatcaaattaacttcacatttcattcaaaattgtctcttcatgaaacaagctccaggtgccatatatcattaagtaaaacaataattaaaattagggactctggcttttattaatccacgatcgtgcaaagaataatatattctgcgtaattttctcagcattgaaagagccattaattccttagcatacactcattcctagcattccatacacaccaaaatttctgatgcccacaccgccctccatacatctgcctccttctttgaacttacgaatacagaatcttgccaaaaatgtgattctggtcattgtggcaacaccacatttacatgcagccagcagccaagagtaacattgcctccaaattagtaccaagaattttatgacatgagaagaaacagtgagataccgactcatctacctcaaggcaaaagggacataagcactcatgaggattataaatggtgtttctcctttttagattatccttcgttggtagtcaatcaatcaagcatcactctccaaattaagaaacacgccttaggttgtatataccttagtgtagtagtatgagaaaaaatatccaagttaaatagaaaattatttttataaatatgaacactttttttaaggcaaaatgtaaaaagaaaagttgcaatttctccccaatctctgcaagaggtacatgtgttaccgtattacatacataaaaaaatggtttctcctaagttaactttcagtcctaaaaaatgccactgttaacttctctaacatcaatcacatttgaagtggctccaaacaccagcaagagaagaaagttcatggttttttgccttatataacaaccactgccatgagatatgttttacggctgtcaaaataccccctggttcacactttttgcaactaaaggctatcatataaaatatttctgttggccgaaatcggttacgtttcttttgatcgaccttggtcgaagttattttttgatcaatgtcggttagaaatttttttgttaaccttagtcaatgatgtttgtgatcgatatcaaccgattatatttttttaccaacatcttgtcaggactattttttggtcaacgtcaccttggttttttcggtcaatgcgacaaagcttgttaccaggaacaacttgaggcacttgcggactcgcttgtcaggtttttcatcattgacatgcaagctcagatggcaagagaccagaaggagatcctgcttaaggttaggagaatacttagcgctgttaataaatttccctcccacacagttgatgcatctaaccctgaagaaaatgcaattctagtatggaagcaacaaatacaagtttgtctttgtcctgctattctgatcctctctctatccagatgtatatatgtttgttagtgcatatatatatatatgcatccatgtatatatgtttgcatatacatacatatatgaatgtacgtagatatattcatatatatatatatatatatatatatatatatatatatatatatatatatacgtgctttgtgcatgtaaccatttgcatttaaagagtttgtatcattatctttgaaacatctttttacgctattttcaatcaatacaagaattttagatcattatcttattcgttacttctctttaattatatttgttaagttaaaaaatattaatgctttaagatgaattaagactcctaattgtaaccacatcagccatactttcccgtgataattcatttctggtttggcaacatttcccacctcaactatctgtgtctcttttagtaaattcagtagggattgtaagattatgtgcttagtttgctttgtttttttagttttatgatgtataaaaaattatagatcagttagtagtttggttttaggttttgttctggtctagatcggatcatgttccgatcttctacatctttagcttttacgcactgtgtgcttgaagctaaggggttatcttttggttcagattggaatgtattggattatgttccgatcttctatcacgcatcaagcccataaaagaggcttaggtcaattcactttcaaagttgggccttgccaagcgggatcaaacgaccaccttaagggggattgacgataatccgactatttcggcagaataagggattaactgattgtttatgatatgctggtgatgcatcatgaagggacaactaacataaacttaatagcacgaaacatttgcgggatatgatggaatattttgatgcagcataaagaccccaacttgtaaaaattgtggggggactgaatgtgcttcattttgaggaggctttttccggaacaggtttgttatatttttattgcatgttatttagaattaaaatctattatgtcagttgtgcatatagcttgcgtcaagtgaatcaataaagattgaactcgtttcatattatattgatttgatagttatatttcttaagtgggaaaatattgagattcttagaacatttttgtcaaagaatccattttaggttcttggattattttttgtgagtcccatgatgttatataggatgcaagaacttctatcatttgttattctaatagtagaatccaatttggattattagattttactagcacaagaaaaaataatatttttgaaaaaatagtagttcttttcctagaacccaatctccatcttaaaaaactcttaataagaataatagtagatctagtggatagggttcttgagttcaagaatcccattaaagatgctattgggcctttgacaaactgtccatgttgtgctactcattaacaaacctgtgcttacatttcataggctctggtgaaaaaatagataaaagttatttatatacaaatatttctaaacattattaaatgtattacataaaaactatagaccaataatatcattaaaaatgacgcattttaatatgttaagcaaataagataatttcaatcaatctcgaacagaaaatatatagagagagatatcgagtttaatacttatgtattgatgatgtaaaatgattttacactattataaattattgtttgaattactttaaaataattattttaaaagtcaacaaacttatcacatagtgagttgcaattaggtaatggtttaaatatatttttggtctctgataaatactcattttttgcatttggtccctaataaatttttgctttgtgataggtccctaatatttaaaaagctttgttcgaagttcctgccgttagtcgaaatccattatcttcatatgtgatcgataaccgatcacgtaagattttttatttttttatagaaaaaagtaaaaaaacgacatcattaagtccccgaatcctccaaaccacccccaccagtccccaaccaactcctccactagctccacaccaccgctattgtgtctccaaaaccccccaaacctcccttgaaaccccatggcagcaacacaacaataattctaacccattttctttttttcttctcttgaaccatggctccccatggcaacaacaaatctccttctctaaaaaatcactcatggaccccccttccccaaagaaaaccctcctctttgttttcatcatttccttctcttcacctacgacacacaagtgagtttgagggccaagtgtgagagagagactgggagagaagtgaggtttgagagttgaaggaagttactggtggtagctggcgctggcacgagcagtggcacgactggcaacaccagtggtggccgatggctgggttggtggtgacctttaagaagggagaacaagaagagacaaccatgaaagcaagggtttgcaaaaagagctcgcaactatgaaaggtcgacgacaagttcagacatcgctatcccactcattttttcgtgctctatgcaatggaccgagcggaatcgcattttagggtaaggttttgttgaccttcttctacccatgaaactattttgatgtgttctcttagaaaccttatccatgtgaatttcttgagttgggagttggcttggtttgatttgaaaatgtaaaattgattgcaagatcctaaaaatcgttggtgaggacctcttcaccttggatcttcacgagtgacgaagtcatagtgacaaatccataagaaaggtatagaagaaactataatgggttgtgtgaaaacgtagaggaatgctgaagaatgattttttgatgcccaagggattttgactatagtttcttatcattagtcaaaatccgttatttgctgaagaatgattcttttatgcccaagggattttgactatagtttcttatcattaatcctaatctcagtcagacaaaaatcacacatgacatgtctgtgtggctggttaacgatcgtgtgagcaaataacagattttgactaatgataagtatttcaaacaaaactttttaaatattaggaacctattacaaagcaaaaatttattaaagatcaaatgctatccattccattatgccaacctatgttccttttccacttcagctagtgcaacttgtacggctgattctttctgctgtcatacacaagcatgtcttgtttctgaggcccatttgtcctttctttttctattccccaccccctcttttccctatccttttatataccttcattatggacctatcaagttctaaccaggaaaattccaaaaacatttctaacccaaatctccaaatttacatgatgtcaaataagaaacaaactaataaataagaaaatgtgattaaaaataatatataacactacagagaaaaaaatcagaaaattaattttccatgcatactataaagagattacaaagtaaaaaaatatatattttcatggaagaaatgttcatgtgaacacaataattaccttgactccgtatagtgatattttgttgcatatcattgcagcaactttttcaagagaatgacttgagtatttcccacctctagcttcttcttcaattttatttgcagaactgttggaatttgaatcagtgggaacttgcagcaagcaagcaacagaagcaagggggtgcaattagaaaacaagaccaagagagcaattacaagacccacttacctcaaggattaggtgtgaaacaagcaggtgcatcatatctggaagaatgatgctggtcgggtaggaatagacaaacttaacaatttcctgatattctgtagcacaaaaagacaaattcgattattgagaaatcagtataaataatactatgtaataacaacatcaatcaatggaatatacaattgttccttcccttattcttctcattcttctctccgtggaggccctggtccttgaaaaccagcttctatcttcttccctatcaacaagtatatagcatatataattatgtatgataattttaagaaaataaacaacactaatataaaatatatagaatagtaaaatacaaaaaaaaaaaacaagatcatatctgcatttccagaagtattttatggaatctagattacccaggaagttaaattaaaaacttgaaagaagaaacagagaaaaaagaaaatattttaagataagttgtaacccggaatcaaaataaaagtttataaataattcaagcacatatatatattttggtgtcttgatcttattgatgtattttgcagacattgatatacttttattaccctatagagctagaacaagatcaactaattgaaggtttagtgacattgtcacaaagcaaagaaaatgcctgatttatgaatattcactttgaatctacgtgagtcagaacaatttcgttcaccaaaatatgccattgcagttgaggtggtcggtcgtatgtgaaagagtctgttatgagatgatgatcttttcatgcatttcggtattgtcctttgcattaacacttacacaacattctccaactgagttagcagtttgtcagtagtgaaaccctccttgtccaacaattccatatgaggaacactacctgacaacattgctgatttcaaaagccttgaattcttggatatctcttataaactcttttcctcatccttgccattgggaattggtaaattagggagcttgcagaatctctcgttggctgaaaataacttctcctgactctatttcagagatggcctccatcaagtccctcaacttgacttgcatgggaatatgcttcaaggtgtacccaacagtagtatgttagaaattctgaggaactctatgcattctgcactctactttttcacgaaatgcctccatttcaaaccaaataaaatggtgatcaaatcttcaattctctcattaaaccaaaaaatatatgaacccaacagtagtatgcccttaaaggtgtaccatgcttcaaaaagcttcatcaacacatgcgaaattctgaggaactctatgcattctgcactctactttttcacgaaatgcctccatttcaaaccaaataaaatggtgatcaaatcttcaatactctcactattactttcctatatatcaatattctcactttctaaggtacaaactatcaggacacttccttttttctaacaaacccatgatcacaaatttcttgaaaaatctaataaattcaaaaggttcatgagactgcattcatccaattctaacagtaaataacaggaataaaggcccatggttcagaaatattcaatcagcataagttattacaacaacaaaccttgtatagcttcttcccagaaccaaattaaaacctttactctgaatttgaagaacaactagcaactgcgtatatcagtatagcttttgttccttaactggccctgtgcaatttgaagtttagcttttgttcgcaacaaatcaccttgatcccatatatcgaaaacctcctttcactgaaaacctccttccaacaaaagatccagaagcactgtgtcacacacttgcacagtcgcactccaacaccgaaaacctcctttcaccgtcgcaccccaccgtagcactctagcaccgactgcatcacagcaagaagccaagaagcatgaaccaaacaattttgcactttgcataactcgaacaaggtagacaaagtctactcaaataagtagctacaacacgacaccgtttcgggttttcgtaaatccacatactcgtagcagactcgcgagtctacccaaactcgcccaagtttgcgctaaatcagatgagtctattccgttttcaattctgctttcgatttaactcgctgaagcttagtggaatcgtaaaatcatacaattctacgatttaaaacatgagtttaacaaccttggatgattcaagtaaaataatcctactagagatcttatgtgcaaatgcaacgaaacacacataaaagtacatattaaagatttaacaatatcataaatttaaataattttaaatatgatagagatcacaaatatcattgatgggatacaatcttactcaatgtcattatggacgtcaatgttcctaccctgagtagttaacacaaatgcaaaccaaaaattcaataataattatttttatttttaaattctataaaatcattttaagtaaatatataatagatatattaaaattaatatattagtccccgttgatccttgtgtatgaaataaattgggttgggaggggaatagtcaaattatgtgcactcagaattcttgaggaagattagtcacttagtatttttattttaaaaaaaattaaattatttactaagaaatagcataaattaaattagttttattctctttgggataatgactaaaaataattcttcttatgggccaaccattataggaaaaaaaaaactctttcgcgagtaattaaaacaattgcatattaaagactcaacaatttatttttaattcgaaattttataaaattagttttaattagaaatcatataaaataaaattaaataatcttataaataaatattttattcattaatatttatattataaggttgaaatttttatactataaataaatttaattttaattagttaacaaatttattacaaaataatgttttgactctatgttaaaaattaattaattaaatatatttttattaaaactaattttaaatcatttcgtcaataatctcataaacttaattagtttaaatatttttgtagtagaaatcataaatatcattcataagaaaaaatcctactcgaaattggattattatatgcaacaaaactatttcttccaatattttataaaactacataccaaaagacttaataatatcatatattataataattttagttatgctagagattacaaatatgattagtgacaagaaaatcttgccaaagactattatagaccacaatattttttttatccaagtagttaacacaactacacataaaaaaaactgaaatagtatttttttttttactttcaaatcttataatattatttttatttggaaatcattcttacataattatataacattttattaaatatatttttatcacaatataattttaaattacttactcaataaaatcataaattatattaattttaatttttacataatatgtagtaataaaaatattaaaatcaatttataaaatgtatttttattacaaaatagttttaggttacttactgaatatgctctttcttcaagtatttcacacaaattcatatcaaaaacttaataatatcataaattaaaatcattttaatcatgacagggatcttaataatcattgatgagaaataatcctactcaaaattattacaaatgacacagttctttcgcctagtagttaacacaattgtatatcaaagagtaaaaataatattttttttttaatttgaaaacccatttttactttataatcacttctacataatatataataactactaaaatttaattattaaatataatttttaatacaatacttttaaaatacttactcaataatacatttaattaatatatattttttatgatagagaccaaaaatatcattcatgaaaaacaatcacgtgtttaacgtcattacaggccaattattatgggtgacaaagctttttctttaagaatatttaacataacaacatattaaagaatccacgatatctttttaaaaatttgaaatcctataaaatcaattttacttagaaaccgtataaaataattttatgaatgaaatattttttgaataatttatgttatgtagttgaaatttttatactattaattaatttaaatctaattaggtaatatgtttattacaaaatattattttgtctctttttttaataacttcatatatggaaattttattaactaatatttataaaataagtttaaatatcattttttcataattatataagaaatattttaatattaatttattaaatatatttttataacaaaatattaaatactgaataatatcacaaattaaattaattttaatagtgttgatttttttacataaatacataataaatatattaaaatagaatttatgaagataaaacaggtaaaaatatgaataatagtttcaattttcaaataatagaagacaatgatttaaatagcctaaaaattaggattttgattttttttttgcttgaatattctaatccttttttcatgtttattgaatataaatactaaatagctaattatcttttttaagcaagtgtattttgaatatgcgtaaaaaaggagagcgatctgcgtaaatgtatgggtatcttgctagttattaacttattgtaaatggagatataatattgatgggatggttaaaaaattatgaaagaaaagaaaatttgtgactttacttccttatactaacaaaaactcacaaaataacgattaaaatttatcaattaaaaaaacttattataaattcaactagaaaacaactttaatttcagtgatattcgtaaatggcagacaacatttcatcacttcactttaataaaggatgcaaacttgcagtagtaagggaaaaatcaagcttattaagacataattgaataattgaagtttatttcaaaattagttaatttaattatggtaaatgttaactagtgtttttaaggtattaattggttataaagaactaaaataataatttttttattgaaatatataaaatagtattatttatgattttttttacatactcttatgattttcataataaatatttttttattttaatttattaactaatgccttagggcactgattagcaacatcctttaggttttagcaaccattaattgatttttattttttagccattgaatttttcattttaaaattattataaaatattaatttattaaatcagaaactaaaaagaacaatttatcaaaattcagagattaaaaaaacttttataattttagtaactaaaaaaatctcagcccaacaataaagaaaaataaatataaacaatttaatagtaaatttaataattttttgcggtgatcaaagatatggttaaaatggaagtttgttgttgacttaatacatgccaacaaggtactatgatgggtgacatggcatgtgaaaaattgaactctcacgtccttgttatgtcaatcttaacatcatatcaccagtcttgtgttagcaaaaatttcttaaatatttataagaaaatttatagaagaatgaaaatcacccaattgttttgggatctatgcaagcaaaagtatacaaacaaaacaacatatacagaaaagtacatacacaccattctagagagggtgtgcttatttaattgccaacaaaacaacatattataaattgagcatgcttatttcaagagtaattaaattaactaccaatttgatatctagagtattactctttcttataaatagtccttaaaataacaaaatcatatataagtaatttctaaagtgttaaatatccattaatgcatatatacattgaaatattttatcaatgtataaggattaatttgaagaatgtttcaatacttgaaagaattaatttatattttattttagtgactatttaagagatgaaattgataatttacgctggtcttatttggattcctcgaacttcaatgctgctcttggggttctcatcagtgactattatagaactcacccaatcttacctccatccacccatcgtttctctgcacagaatgtccatgcaagagtggggatgtcacggaacgttaagggacacctcaacaggcttgttcctgaacccggtggcattattccttagcctaaacactaagtatgcctcctataccggaacttgtttctaatgattattttttaaaaaaaataacaaattaacatatttaatatattaagaatacaatgtatttgaaataaattaatttcaattctatggtaccaaaagtaactggatttgaaacatgtttcaattgttaatattttggtacaaggaaaatttccgagatagccaaaactgtcaattgaaaccttgagataccataaatatgacccaacataatcatatatcatatatatactcctaggaaaatattttttacatgaaataaagtctcctcatccttgccatatgaggaacactacctgacaacattgctgatttcaaaagccttgaattcttggatatctcttataaactcttttcctcatccttgccattgggaattggtaaattagggagcttgcagaatctctcgttggctgaaaataacttctcctaactctatttcagaaatggcctccatcaagtccctcaacttgacttgcatgggaatatgcttcaaggcaatttggattaataaattactctagaacctgaaaggttagttaattcacaatttttttttaaaaattattattaccaaaattttatgatatcattgatgtttatatttttatttattatatatatatatatatatatatatatatatatataaaaattattacattacttaaaaattatttatgaaaagtaaatttaattaaatataatattcagtaactattcaagtatatataaatataattatcaacttgtataacagagatatacttttagcttctttttagaaaatattactattagctttaaaatgatttatatatatgtgatattttaaattacattttttggtaaaatattttaaattactttgtatcacagttattatatatctttaatattttttttttgaaaaaatagaattaaaattaaaacttaagatcgagatcaatccaaacttattaaatcatatttaaattttaaactacatcaattgaacaatgaattaagaaaaccaaaaattgtataagatgatatttctctttttcaaaaccaatttaatctactctataaactcctcttaatcggacaactattagaaaagtgaaaaggaaaatataaaaaattaaaaaagtaaataattcgactttgtagaagtcataaccacattctttatcatccttctcttctctatcccctcattattgcacctgacacatttgtttaacacgttgtcatattgtctgatcaataggaatatgatatatcgcctctttattttctaatcatgtaattgcactgatttattttctgttcttatcatgattggtttcacattattattatgtcatgcacttcatcatgatgtgttgcactaatattaatgatcgttctacaaatctttgttgtaccccttaaatttcattagcttctgtcttttttttcttatggaaattaattaattaacattgatttttgaagtgcttgttaattacaggcaccatggaggaaagagtggggcttttgtttctgattttttcatgcaagagaggtaacaattgttagattggcctttttcttatctttttgcttttaaatttaattatcgtgctaagttagatggatataacgtagttacaacctcacactaaatttactgtaccataataaagtttacctggttcttgtagtaaaaatataaatagtgatgaaccacataccttctaaaaccatacccatacctgtttcatatacctagtaacttagagatagaatgcaaggcttgcattattcactctcctatatatttatttaccaaactttggtggaaattttaaggagtgacaggttcatattagcttttaaccatcaatggaaaactagaaaaaagaaaaagctggcactaacaaccagttatttgtcaataggaaaggaagcttgggcccaattgaaggatgttgtggaaaattagtgtctctttgatttcagaagctttacttttttttttttttccaatacttacaaaaatatcatcatatttttttacctcatgtcatgatttgaagaatgtgttttgctacaaagtactgatactttaatttgcttcatgcatctatatccgataccaatatattgatatatttcactggtacatatatgtaaagtgaccaattcttttaaaaaaaaattatgataatcaaatatagtgacatgtaacatagaagtaaatataatatagaaatataaaaagtattgtttcttgatgaaccaaatatgaaaattgttttgtttatagataatttcaagaaagaaatgagattgatcattgatagtaccattcttatttgtgaacaataggaaaaaatgatctacaattttttgattttgtttttagcaatgtctaagaagtatgtatgttcttcaatttaccgaattgcaattgtatatttattatgcttttatcaattcttacgtatctacatatctatcatatttttagaataatcataccactattaatttataggacaggagataagagataagctgaaatcatccaatccttctaaagttcacttggtacaccttttcatccttcacattgtacctaacaaaaaacctcacaaataaaaatttagctattgagaaagtgtcaatttgacgtcaattaaattaaaagttacatttagcactagttcaaatttgaacttagattcatgggtaggtacagtttctccgggccaatcaaccatatctgaaaaacaaaaataagtttcccacggtcattttcactctggcctcaataatcttaaggagaaattaagttagaatataacaatactgatgtgtaacatttttccggagaatcattatatttaagtatttatcaatgttgttacttagtacctgtatcgttacttcttcgaaacatatatacaaggtcaatttccacgttgcctttgatgatttgttgattctctgtagattcagtaacatatatacaaggtcaatttccatttcagaatgaattggatttagtaaaacgtaaaaggagaaagacatgaaatgaaacatatccttgacagaactagttttctagttggttagacttagaagatacctgttggtcctccttggtggctaaatccatctattgtcaaccttaatgccagggatgtgggaaattttaggccaaatttgagggtgcttcttccggcatcgttttttcagcaaaggacaactctttatggttaattttattagagagtcaggaagcctttctcccaccatattttccagcaaaggacatccgtctatggttaattgttgcagggatgtgagatggagaagccccgtgcagtccaacatctccagatttgagaatccacttagatacagatacgtaagggagggaggcagcaaaccctccttagggaaggacttgatgccatcacatcgacccccaacatagagatgagtaagcatgcccatggatggccatgctaggctgctcagtagtttctcacaattgaaaatccaaactattctcaggttaggtggcataccccgttttggaaacgactcaatttctgggcagttggatatgaggagacgttctaactttgggagaagagtactcatctcatcaggcaacgacttcaacttgtcagagccccacacttggaaagtaatcaagttgggcgcaggcaatccttctctccagaatgataccaaaagagattccatattttcacagtttctgatttcaagatctctgagatttggaaaggtaaccaatggaagagatgtgagtgaatcacaactgctttctattgacagtgtttccagtaactcatgtttgtgttgcgtcgggaattccagttttttaagatccgagatatacagactcttcagtgattcaggtaaacgaccacccggaaatgacacggctgacgagcaatcccttaatgttaaagaccggagacaagttggttggatgtttgtgatggcctccatcatggactccaccattgggcttccttctacttttatagtttctaccaagagaggaaacgcatgcagtgctactttattgcttttacgtatctccaaactttgaatggcgggagccgttgggagagaagagccaagcagctcacaatttctaattgtaagtgttttcagagcaggaaggtgattcggcaaacttccctctagtttggggcagtcacgtatttcaagaatttcaagcacaggaaaagcttctgaatcgaaggaactccacacctcccaacaaggcatttgatgaatggccagagattcaagggagggaaagggcgtcccagaacgacaatcttcgttcttgtaaaaacctgcatcaatagtcttcagcctattcaatcgtgcaatcttaaggaccttgagagaaggtagttgtccaagtgaaggaagcatactacagttgtcacaatcacgcaattttagactcatcatattgcagtaggaagaatttcccatccaatctggaaatctggttcctttatagccttttattctcaacgattcaatgttaaagtgaggctgtaacttgcaaagcacatctatttctagttggaagttggtactgttgttattacatctagaccattccaaccataaactattaatgtgttttttatccatcatccttgcctccgacgcttcatcactttgggaaacattctccaagttcctaattttaagtcgaccacgaagatttgaaagtcctcccaattctttgatcccattctctttgtgcttgcccacaacaaagaaatccagatgttgtagatgatttaatttactcattcctctcggcatctcttctataggagtttcacgtatctcaagatgacgcaagttaacaagattgcacatgtcactaggcaacttagtcagctttctgcaactacacaacttcaaagtttgcagattgtataaattacacaatgactttggcagtgtttctacacttgaatgagaaagatctaaatagcgcagatggatcaatttacctattgaatcaggcaaagaatccaaactttggaagtcacaaaatgataaaactctcaagtacataagcttcgacacaatgatacattgtgcctcctcgttgttgaatggagcagcttcaaaattgataatggacaagaaagttctcagaaattttgctctaccaacaacatcaaagttgtccaagactgaagaattgaatttggtaaatgacaaatgacgagtcttagtattgatctttgtttctttcccaagttcttctgatctaaaataaaaatctccaccgagtgatttggctagatcatgcatgaggtcatgcatcacaaaacattcaccataaggccaactacttctatttgtacttgaacgttggaaaaatgatctcgaaaccaaatcatcaaaatactcatgaccaacctcttctaaagtcctacctttccttggtttcttcaaaagatcttcagccatccacaacaagattaattcatttttatcaaattcgtaatcttggggatacaacgaacaataaacaaagcaccgttttaaatgtggagggagataatgataactaagtctcagtgctggaataactttacactcactttcagaaagttcccaaatgtcactattcagaatattataccaatccccaatgtcatgctttcttctcaacatgcctccaagggactgtgctgctaaaggcagtccatcgcactttttaacaatctcctttccaattttttctagtgttgtgttctcgttcgattccaaggaaagacacgcatggttcgcaaacactgaccaacaatcttcattcgacaattggtttagatgataggtttgaaccgtttggactacggaggctgtcttttcactgcgggttgttagaagaattttacttctcctaataatcccacattgaaatggtttcttaagaagactccaatcaacataatcctctgtccaaacatcatccaaaacaattaggaattttttatctttcagcttgtccatcaattcaagatgaagtagattcagatcattcaatttacaaggatttccagtaaccgcctgtattatagtttttgtgaccttcagaacatcaaattcttgagaaacacaaacccatgccttaaaatcaaaatcaaatttctctttcaaattctcatcattgtacaccaattgggccaaagtagtttttccaaccccacccatgcccacaataggaaccacagacacttcactaccgtcactgttatcctccgacaacaacttgattatggcctccctatctttctccctaccatatatatgagatccatcttccagagatgttgatggagctttccatgacaagttctccactgcactctctttcaaatcaagactctccttgagttttaaatgagactctagggtgacaactatgtcctccaacttactaacgatcttccgatcggaaaagcgagaaaacaagtttcttaccttgttttgggtggcagctttggtgaaaacatggtcgagtaagtcatcggcttcatagacagcatctttgagagcattgagccagtgtttgacattggtgtttgtgatctgtttcttctcggcatcatcaagcacagctccaaccactctgagagtggtctccaactttcgaagcaacttcttgctaagcttctttccaaggatcaagtcaacaaagtcaggtgaagccagcctgtcgaaaagcacatcaaggaaagcagagagaaaggcaccaccgaccagtgctgcagccattatctcaagaacaaaagatgatcagagtagaaagacaaaggcaagggaattggttgctatgaactgatgtgatgagatttggcttaagtcaactctcttcaccttcactcgttctgctgtgcaagacaaaagtatggtcttttttatttttattatttgtattattatggtggtgggtgacttatcacgttgggagtctctttacttttgatcctcacatatgttactttcttgatatttctattttgaatttagctcctctaaactaaagactcaagagatttaaagagtgatgatataaacaactaacacatgatgagatatgttattgtataaagatctgaatcatgattttataaaaagttaaaataattgatagtaatttatgttttttaatcaagtggtaaaagatttaaatctttattaattcttatatatagaataaattttgttaggaggaaaataaaaaaatgagattaaaaaattattaacacaataaaaatgttgaacaaattaaaagagaaagaattaaagaaaagacacatgctaattgatccctaaaaacaataatatatattaatgaagtcaagatttgaatatccttatatgtagattaaagatgtgtgcaaaaagaaaagtgtgtgattttttattaaataaaatcaataaatactaataaaataaaaaatattgtgaagatgttataataataataataataatataaagagagtgattaaagtaattcttttgaaatgatggcatgaaaaattattattcaattcaactcttttttttatgttatatatctattgtaattatttgataaatacttccataaaatttcttggttggtgattatcctttgaatcttatttatataaaaattttattattaatatattcagtgagatcatctcaaacaacaatagtaaaatgagagataaagaaaatttaagttcagcaaatgaaaatattttactatatgtaaaaaatattttttctcctatcatatttaataaatataattttattttaaatcaacaggtataaatttttatcaatagttaaaatagatttaagtgaacttcctagaaaaacttttttatttgtttgtttaagtgttgaagatatttatcctctaacttattttttctcattacaattatttttttctttttactaccaaacaaaaccttacaggatttttttactccactacacttgctctctcctcattttttccaaaatacacctgcctcaaaattgtttcctaaacaacactcctttttagcttgcagagagaagtcggggttagggaacccaacttctctttgctcctattattttttaatttaaaaaaaattattaaattctttttttatatttttttaaaaataatttacttgttttttaaatattattttcagataaaaaaataactaaattttttattattattattttgttttttaaataatgagaatattttttgtttaattatttatttatagtttgaaaataattaattaataatcttaaaataaatttaaaaaacaaagtgattaaaaaaatagattgattaaaaacccaataaatatatgattatcacatcttaattatattatattaagaaattaaaatactcaaataacataaaatattaaaaattaaagagacaaacatcataaatggaacatataataaagcaaaaataacagaatggactaacaataataattgaaacatgaaaataatgaaagcataaacaactaacacatgaatcattcccattatcaacctcatttgattattaatccttgggaaggagacatgttacaacctaccatagtttttttacctaacaactatggtattcattctagaaaaaaaaatgtgaaaattttcgataataaaaacataacagaaaaaattatttcaatatatcttcatcttcagttttttcttagataaatattattgttcatgtattttatttatgatgtaatgtattccagtataaataaattgttaaaaatatatatataattagtttttatacatttttaaaaaaatactataaacaaaaaattcatttattaatttaacttgttaaataaaaatttattttttaaaaaaagaaaaattaattcctttatttttttaaatattatttttacattaaaaataaattaattttttaatattactgttttactaaatatattttaatataaaaataatatttaaaaaaataaaggaattaatttttctttaaaaaataaaaaaaagttaaatattattattatggtggtgcgtgacttatcaggttggcctagatgctaatatagtaaagaatattgtgaaaaagttgtaataagaagaagaagaagaaggcggatacaagctagatcttacataatggtaattaggaaaaacaaaaccagagaccccctctgatagggaagagtgatagcatagcatacaaagggatgtattcagaaaaaatagatgtgaatcaagacatagcaactacaggggtgtctatagcaaagaagggtgtaaatcaagtagaaaaggaggtgcaagcagcagttaataccaaaagaaagatctcgaagcctgcttaccttaaggactacgtgtgatcctaaggaatgatgctgaatgatctgtgctagaagcaagggagacaagaataacgatttctgatttcctctagcacaaaaggacaaaatctgttatgtagaaatcagtataaatacaatagcatgtaataagcagcacgatatgaatgaaattagcaaattactctcatctctgctcttcttcttcctctggaggttctggtgcctcgaagccagctcttaatttcctgcatttatgttcagttcgtaacaattggtgctctcgtttgtcctcatggcctcacgcaacctcgacaaggcccttgttcgtcttgacaataccatgcactctatgaccctcaatatggacaagcttcgcaaccgccttgctcctgtgccttcctccaccacgcccaaccccacaccagtcccttgccactccacctctgttcctgcacaaatccgatatgcctcatcaccgtatgaggatcctgtcgatgccttgttcaaactcactcagacgggttcagtgctaacatacctgaaggagttcgaagacttggctaatagaattatcggcttgtcggcccccttcctgttgccttgcttcatctcgggtttgacgtcggagatccgccgcacagtccaggtccaccagcctatgactgtggaccaggccgccagccttgcgaagatccaggagcagaagctatcggaccttcgtctgcctccaccgcggccgcgaccccaccgttggtagctccaccaccagcccctttggttccccctcgtatcacgcctttgccccctttgctgccttccccgccataggctccgaccgtcaggcgtctcaccccggaggagttagcctcgcgccataagcacgggctatgcttcacattcgatgagaagttccatagaggccattgatgtgcctctagggttcatctcttaatcgcaaaggatcaggaacctgtagactaggggtgggtaaatgggcccaggtccatggactggcccgtggcgcccgcgatccgctcgagttacgaaccaattttttaaaacagttcatggttatgtcatattttttggtccgccccgcttaacccgcggactatgcgggtttggccgcggggtccacgggttgcccgcaacccgcatttggtttgatttgtgtgaccctgacccaattatattaggtttgattttctctttttcactttaaacttttcttttaaaataacaaatgaagaaatatattatataagataaagatttaaaggtaaaaataaaagatttaaaggtaaaaataaaagatttaaattaaaagatggtaaagataaaaaagataagataagaaaaataaaagataacagaaataaaagattaagataaaaaaatataagtgataacatgctaaaaatcttcctttttgatattttctcgatctttttttcttttaatctatcattttcatatttgcaagtcataaataataaaaatatcaattcttatcatttaagctaaaaataattgttaaataaatatttttaaagatatttcaatatatttttattataaaaaatagttcacatcatatttaacactctttcccttacaaggaaaacaaaacgcgactcatattcacgcagtcacgcgacacaccacagcgacacagcttcggcccaccaccgtgccaccacgcaaagtacatctcttctctctctagaatttgtttttatcctatttttgttgggactgattcatttttgttgtactcttaaatgtggagatggagaatgttcaagctacttcaaatatggaatcatttattgttagagatgtttaaatttcatattttagatttattgtttggattttcttttgttaagacattatttattttattgatgtaattgactaattattgagattttatttacatctatattaatttaattatgttgcacacattgacatggtgtttttgaaaagtcaatccaataaactataccagttttagtccaaatgaaatgcaattacttaaaaatgattgcacaaatgtttgaacctagtatcacctgcaaactacccaaagaccttgtcactagcccactaccagtggcacgtccaatatgatgagcttcaataaacattaaaacatcatgttaaaatacaataaaggagataaaatggcaaggtgtcagccttcaagcataaatcaatctgcattctgcaagcaaacatcaaatctccttatttgtgcctttctttttaagtcatgcaatattatgtatcgtttactgctaagcaagatgaaagagcaatcataacatcatgggtcagtacaaacaaatatactgcaaaccgaaatgcaaccttgtttacagcccaatgcttcttttcaattaatttcattccaacatagcatgtaaattgaacaaattaaaaaaattactatccataacatctatttcgatgaactatcgcatagctaatctatttgttcggggtcttgaagttaaagcttggaggacaaaacaaagtagtgtacaagtacttggtgctatggcataccgtgctcctcaacatttgtctcggtgtctccttaagattgttcccaaattgactgagatataatatgaagcaaacattatttttcacttctaaattccttttaagctatagattgcattaccttaacccatctcggtatttgaaggttttgactgatacacatcctatagtcagtcagctgggcaaatggccccttcaacacgttagtcttgacttacaaactattctatccatttgattcctgcttctgtgattaatgttttttatttcatgtttttttcaggttgggaatgtgataaaaagttcagaaatatctggtcttgtccttactctacttaagtaaattggtgttttcggtatctagagggaggaataaaagtaattcttttaaaattgtggcataaaaaatcatcatttaattcaactctacttttatatgttacatatttattgtaattgtttgatttatatttttatgaaatttcatccttcaaatcttatctatacaaaaatattactgttagttaagtaaaaaaaaataatgagattatctcaaacaacaatagtaaaatgagagagaaagaaaatttaagtcaacaaagaaatgatgagcaaatgaaaatattttattatatttaaaaaaagatatatttttctcttatgatatttaataaatataatttctataaaatatttttttttattttaaatcaacaattattatgaaatataagtttttatcaattgttgagataaatttaagtgaacttggtatcaatgattattgtgtagttaaagtcctagatccaactactcataaaaatttaaattttctttacatgtaatataaatagacataactctaaaaatgaaaactttttttattagtttgttaaagttttataaatatttatcctctaatttattttttctcctcacaattatttttatctgctgtaaaagataaattataatgtattttctaacaattttaatatactattattatatttttatttaatatttaagaatatttctataatttaaactcatgcactaagtataaattatatttgtttccatgacattaatacaaagtatttattaattttatatactgataactcatcttcatagagaaatttagttattcatctttaacgaagtcactattttcaattatttttaatatgtaagacttaaatctaaaatcttggctcaaggggatttgtcttaacttttcagttcatcatgggaaatgatgctaaagtcacaagctaagtaaagtcttaccaataattatttctgttaagccgaactcaggtaatattcaaacgattcaactttattttaaatacactaaccacttgtactcagtcacttagtcacttggttgcaacagatttagtttcactctaagcaataacatgttggtcacaagaatatatattacatattaactttgaaaataaaatataataaaatttctaactcaactttttaattttcttattttcattctaatagtatggtcactcattgtaatggcccgcctcttcgttacgatatcaccactctaaactgcgaaaaatttcaatttttaaatgaaaaactccattaatttgcttatgaaaaattaaagtaattttaatttcacgatatacattccgaaacaacgcatcattacttaaatgaatacatacatatatataggcatagtaacttagtacacatcattcacacaatggaaggtaaatttgttcatacatataattaagtttgtgatttacatccttaattcaacaaaaaaattatggaaccaactatgaaggagttgattaacaaaacacaactctctctcaaaataatctcaacgtcatcacgtcagttcggcgacttcacatcagaatctcactttctgcaccttactgctgtcattctgctcccacgaacaaggttcgcgatcatcacaagtatcaaccacacgatacaaaattgcaagggtgagttcattataaaaagaactaatactaaattcaaataaccacaattagcaagaaaacattaacaaatatcatgagcttatacaacattcattaatcaacacacactcaacaaatagtcatcattcatacatagttccaattaatcatgttcagtatgatgcatgcacctgatctcaactcttagatgcaatgtggtaccatccccaaggaaatagcataagcgtgtccacacgacactctcacttagaaaaacaagacaataagtgtcgaggtcatcctgtcgtacacatgcaactctttaaccactctattttcccccaccaaggacatccgacaaagtcaatgcacccccatgaacatacacaacatacaacgtataaaatgtgggcaccatcaagtacactgaccatgaatgaattaaagatcctaagtcatcccctcagagatgcttaaactctttaaccactttattttcccctaccagggacatccgacaaggtcaatgcaccccatcacgaacatacacaacatgcttcatctcaacgcatttccaacatcatcaacatctcatttcaatatcactctcaacatcaacatctcatcatctcaatgacattatcaacaacaaccacatcatttcatattaacataatcatcaataataacatcaattcatgttgacatgatcatcattaacaacgtcatctcaaatcaatatcatcataaatgtcaacatcaccacatatcaattaaattcatcaataacaacatcaacaataagtcgcattatgcatatacatatatctttcatgtctgagattcacattctctaggatttcaaacaacacaagtctaatcaagacaataatgatattcatcaataatagatatatcgcatctcactcgtcaaaaacattgttttctaaaaaaaaaaatcaacatatagcagggacaagcatatatatatatatatatatatatatatatatatattacattgcttaaaattatttatgaaaagtaaatttaattaattataatattcagtaactattcaagtatatataaatataattatcaacttatataacagagatatacttttagctttttttatagaaatattactattagctttaaaatgatttatatatatgtgatattttaaattacattttttggagaaatattttaaattactttgtatcacaattattatatatcttaaatatttattttttaaaaaaatagaaataaaattaaaacttaaaattgagatcaatctagactgattaaatcatatttaaattttaaactacatcaattgaacaatgaattaaaaaaaccaaaaattgtataagatgatatttctctttttcaaaatcaatctaatctactccataaattcctcttaatcggacaactattaggaaagtaaaaaggaaaatataaaaaattaaaaaagtaaataattcgattttgtaaaagtcataaccacattctttattatccttctcttttttgttccctcattgttgcacctggcacatttctttaacatgttgccttattttctgatcaatatgaacatgatatatcttctctttattctgatcatgcaattacactaatttattttctgttcttatcacaattggctccacattattattatgtcatgcacttcatcatggtatgttgcactaatattaatgatggttctacaaatctttgctgtaccccttaaatttcattggcttctgccttttttttttcctggtagaaattaattaattaacattggttttgttaattttcttaagctcatcaaaatattcatagaaattttataatatttcctacataatctcgtaaaaaaattgttttgcataaattaacttaatttgtattgtgtttttcccgattcaatagcatatgagagtacaaagccgtattaaaaaaaaactaaacagtgttattagtaaagtggaaaatatgtatttaaatattataaaataattaattaagaaaatagttaacgaatgaatagtataattaattgcttaaagtcacctataaaaatgatattattaatattattgtatttaacttatatattataattttagttatttaggcttaggtatacctataataaaaaaatgttataggtatagtggtttaataaacactattaatgtgtgacatgggattgaatcaaactataacattttatgaatgttttcatcattttagtctacatcactttaaaaaactaaaattctatcattatgcaatacaaaaaaactaaaatgacatgattataaaactcccaaggactaaaatcaaacaagtcaaattaaaaatcaaataagatgccaaattaatcactatctcagtttaatgccaataccatatcaatcaatgccgccaactatcaaaaggattaaaatctcacacttataatattcaggagactcaattaattagagaataaaattatattataatgatacatgagaaaataagtataattaagtcaaatttttacacataaaaacttaataaaaatcatatgtctcctggtagaaaaagtcttactcaaaattttatctagtgttgattttttttaatgtatcagcgttgaatttaagaagtatgtacattttttttatttagtatcaccatatgcaattaggatcttaggttcccaataatattctaatgtatgttcataaactttgattatttgaattaattataagattaattttcaattagaagtgagacttaattatacttaaaaattattatttttttcaaaaagaatgtattttacaaaaatcaaactcaaattctaatccataaacttaacttatattatcaaatgacttatgttgattaattctatctccatattatgctttaaggtcacaaataacacaatcatgcgagaaagaaaaataaataaatttattgacgatcaatagaaattaaatagtatcaacaagataaatatgttaagaaaatagaaatataatttttattaatatgaaactgtgaataaatatatcatcttctataacattatttcatggttattgataataaaatattaaaactgaatcacaactaaaaaaataatatatatatatatatatatatatatatatatatatatatatataaagatttagaattaaatttaaatcatatttaatgtctatcattaatgaattataacaaaataaaatgtcttttgattatcataatcattataaggatgttgaagataacactttcggccatcgccaatttgaacaaagatcaaccgataaaatccgcgagatatttttggttgcgtattacataatccatacgtaatgttaggtcatgcgcaaatagtaaactgtattcgaatactatctctgtgtatttttaaatttatcttaagttaaaaaatttatgttaacttaaaataagatacaacaaaaattaacatactagtttgcaaatttattttgataaataaatatatcataagataatgtacaaatatttaaacataaaaatatttaaataataaaagatagatttaaatgtattttatattttaaatccaggcacagcaatcacgcgtgcgattggcactaactcagatggagatggctctgtcattgtcttttacctgtcgactcgacgtgattcctttacttttgcgtcaccctcgtcatcacacaacacactcacgtcataataacttctacttactcaactgaaaaacgtgcttccaactaaaaaaaaaccataatactagtaattaagttttccaaccaaacacattagttgaaactctgttaaaagaaaatattagttgaagcttttaaggtttaagtaacagttataactgtcaaagcttttaatactaatataaaaatgtttttccgaattactactattatgtaaatattatttttttcattgctatgttatttgtgtttaatttgtagacgcacttaatgtaaaatgtttttccgtattattatctaaatattaaattttaattgctttgttattggagtttaatatgtagacacacttgtttagtaacttgtacactcacttattgtaaaatatttttatatgttttgtacaaaatcattttatcgctagattataataattattaagatgatgatgggataaatttcctctacaaaattgatgtgataaaataattaaaccctattgaatatttctatcaaaatattttacaataatgagcattgattaaacttatgatgtatattattacacgtataaaaaaattggcgtattattatgtatgtgataatcatacaattagaaatttattatcgaaatataaaaaaactaaaaaaatatatttattgattaacataacatatgtttgaattaattttatacaaaaaaagttagtagctgatttattattaaataaaaatcattttattttatcacatgtataaattaaattatttataacaaggatttttacttttcattttagtttcacaagtacaacctgtaaaaaaaataattaaatgttttattacacaacttatgtaaaaagcatagattttggaggaaaagtattataactacatgattttactagcatatattgtaatattcttgttatctgtgtttacagtgtaatataaatatagatatagtacggatacagataaaagataaagatgaatattatttatacttcaatgttcggaaggttgaccaatatttaattgggtccacatagaaatcgaaattggacgaaaaagggcaaacctcttgacgggtgaatacgtgctcctacgttgtggctaacaaaggatactatagtaaattcatcaaaataactgtatctaagtggcgcattttccggtgctagcggtcgcattttccattatacgctatatttctgcgtatttatctgttcttttggatattttaatttgggtactttttttgatgaattttttaatatgggtactgataacgttcaacctaaaataccaaaatagggtgcatgaaaacattaaaaagaagaaatttgaaagaaaaaaaaatactactataaagtgatacgatagagaatgagaaaattactttaatgcttttgataattaatattttaactcgtgtataatttataggtatttttcacattttattaatatttaaaaaatttaaaaataaatactaaagattttattttataaaataaatagcattcaaaagataaggaaatatattaattatttgtttattatatattgtttataaaaaggtcatgtgaatagtatcatcaagaaaaaaatcaagcttttatcatgtcaagaaattcttttattacttaaatacagtttaaaaattaaaaaagtatataaagataaaaaaaacgtattaataaaacattagaattaattaataactttctatttgattttttcaaaaataaaaataaaaataaaaaataaaataaagagtgagaaaaaatatgttactgtttattattatgaaagtcgatcatattcaaatgtttgatgttcaatatatataaagtaaacaaaactgtgttctcatttttttagtcatattttttaaaacttctgttaaaaaaagtcatatgtttcaatatatataatagaatttattttatttaaagagaagagcttgaaatgaacaagtgacagatatttataattttaaataaagaaactagtgaacatgtttttttaaaatattaataattttatatataaaaataaaataccaacccttcctttctcgtatacgacatacggaacttttttatttttaattaaataaattatactatttgtcttagaatcctatttttaaaataaattttgtaaaataaatttattaattgtttaattttattacagttagttatttaataagaaaatctatctcttagttgattataaaggatacagggttttttctgtccctaaattttttgtaaagttcacttttagtttcgaaacaattttttttttagctttttaccccttttattttttttatcaacaattttagtctcaattatcaagtatcacccataaccgatgaaataacagttatgtgtgactttcattgttattaattagtctaatgtaataattacttatgaaattttattttttgacaaattatatttttaatcttttatcaattagtctaataccactaattattttaacaacacacaggactaaaaatataatttataaaaaaaattacacatatttttctatatcaaaatcatcaataaggtgacaagttatgtaactaacaatgtaaatgtcaggttgtcaattttttcaacataaaattgaatattattaagaggatatgaaatatataaccatgtaatagagacatcatattatagactagcaaagacttactatcctaccaagaatgcaaaattatacaaaatctttaagacattccatagaacaagaatagttgttggcaaaagaaataccactaaaataaactccttacacctaaactaggtccactaaaatgacattgtgaaaattgttcctctacaaccatatacaccagcatgtagcataccaaactatataccaaaattgacacattttctttcccccctaaacaacaacctacgttgaacataatgttgttgcatctgattgtgttgagcctgacaaaatgccaaccattgatacacacatatccatacttggtaagaaaagtgattttggaagatcaagtgattcgtggtctccacaaattgtaagcacaacacaactagtaccatcgtttgcaactcctctgtgaggtaaagccacctgagttagcaaccaatctcgtaagagcctccttaaaaagacatgttggaaagggacacacacttccaaaaattcttcgatagaaatcctaggaaatctttgtttactattacatcaagagtaaaatagcatatgcagttgctactgagaattgttgagagccaccatgactctatacccaagaatcttgattgtccttggccaaggtaacaccaaacaaagtttgcatcagctagtcattcaattcttcctcccaacagaacaacctacatctccatttccaacaacactgccatccaaatgatgtccatacacccatatccaccattacgttatcttgtgtaagatagatgtgataaagatgacgaaaaaaaaagccattaaacaagtatcacctaaccatttatctttccaaaacaagatccttaagccatttcctacactttgagtaactaaattaagaaaccaacaatcatttgtctaaactcataacatccttccactcattagatgtatttctgactgaattattactactagaatttgaattcaatctctcatatttaaaacaaagcaaattataccatattgcatctttatcagacacaatttgccacctccattaaactagaagactgatattaaacaacttcaaatttttcactctaaaaccacttttaacttagggagacttgctgcttcccaattaacccaacatatcttctttgtctccaaaaaaccactccacatacaccatctttgtaattttatctactcatgttcaaagttcagacctcatttgaggcacagaatttcgtgctccttctctccttctccctccactcatcttcttctaccttcaaactcttatccatggcttcctatagtgatgagcttgttcttgactcatcttctccttaaagtgacgtctccaatcatttttcttcttctccatttcgctaccattgatcttaaagaaacaaaggactccattgataggaagatccaaggcctacaagctcaacatggagctacatcgtgtctttggggctttataacaagagaaataatataaaggaaaacataacaacatcgaattcaacaaagtaagcctccccctaaagacaaataacgccttttccactgaaacaactttttcttaaataagctaaaagttggatcatatgtggtagctcactcgggattagcaccaatgactattccaaggaatataaaaggcaacgttgcagtcgaacaatgaagaaatgttgatgccataaccataaaattatcatgctcattaacaccatatattttgcttttaagagagtttaccttttgtacttgccaaaaattggagccagactaacatcagagttgtccgtcgttagtgtgggtactctagtgatcttcgtggtggtgaatctgtcagtatcctctgcctgaggaatgaggagggagtaaaaggttaagttaaagtgaatatagaacctgattatttatagtgattggtgaaaatcctagggtgttgcctgagaggttgttgcaacatcataacaacctcattagtcaggtgtaaccgcattgcaacaactttgtaactaccttgacagccagatactcgcgtatcgaaatatcataatgacctaactacttagccatgtggcgctaaggttgaccttctagagaacatctgtgttcatggtctagggctgaccaagatggagggctaataaggactactcaatgctgcatcactcgccatgtcactcgtgaaccctggacagtacaccttcaaaccagagacaggctcaaagattcgtggaatggctttaagagcccacaagttgtcccaatatgcctcaccaaacatcatcaaatcatttgtgtattgtattaaagaaaaggaaataaagtcataaacttcaaagcctttaacccctacctgcctccacaaatttactaactaagtcattcaatcccttaaccattataagggacaaaaagacaccaaagaatcaccttgtttagaccactttcatccagaaactccattattagactaccattgaccaaagtagacatacaacttaagcaagttgctttaatccactttctccaagcactatcaaatccaagacagtccaacatataatcaaataatttatcattaacagagtcacgccatcaattaatgctacgacttaaaaaagaaaactaaattttttaacaaagaataatataaagacaaaaaaatgctaaaatttttgtctaaggactaaaacataatttaactatctaaaaaattattctcatttaagaatgtaagaaaattttattcttattcataatttaacatttaaaatatttgtattttcacacattaaatatcaacaaattttattcatacattactatctaaaaaatgttaacatatatttaatatttaattaatactaaacattatctagccaaaaaagaaacaagataaaataatgagtaacaatacaaccacaatgatattgctaataataaaagctacaaaaagaataataataatgatgataaattaaaaattaaaaaaagagggagcaagtgggggagttggccgagtcttgaagtataatcatcgtgcatgcattttggtgctgtctttcttctttcttatattctgcatgcacacgcctcctctctctctctctttctctcagtttcacccctctcttctctctctctctccggttaccatcgtccattcaaatctctctccggtttctctccgttcagattccgacaatcttccgatcacacttcattattcctctccacaacgcgcgaatgcgaatcccaaacctcacccctcgcggcacctcctccgcttaaaaattaacttccggtgaccggaacttcccctcgtgaacttccggcgaccggaggaaccactcgagcttcgctctcccgcttaatttcggtacgggcgcttctccgcagccggattttacatccggcgtcgcgcgagtcggtgaggtgacagttagggtttttcgttctgatttttctgatttttttttttgcagagtctgtgtggaattggagttgaaaatggagtcaaggagctgcatgaacgtggcgtgcgccacctcgacgacgattcggtggcgcaaaggctgggccctgcgatccggcgaattcgccgatctctgcgataagtgcgggtaatgatgctctagatttcgaatcgatgagcgtgtgttgaaattgacgcgtgagtttgatacgtggatgcacggaacacaacagttgattagaactttggagtaattttgtgatttgttgctttgttattgttaattatttgctgttttggggttttttttaatgtttttactttgaagtatttaatttagttatttcttaatctaagttttggcttgtggatacctttttttccttccaattttctaaagttagtgtagtggctttttttgctgatttttttttttttttgctgaatttcagtgtagtggcgtttacacgcttttatgtttttttttattatttattttttaaattgtgtggtaagtagtggaagacttgaagttgtcgtaggtaaaattgggtcgccgaattttaattgtggctgctgaccagagaccacaatttaaaacgttgtttatgacatgtgtttttatatggcatgcgtttattttttttttacacaattttatatggcatgtgtttataatttacagtattaattttccttacttttttttaataaatgacaaaaaagaaatacttgtgataaaatgggaacagagattaaaagaaaagaaaagaaaaaacatagtagttgtatagtaaccagtttgtccgattgta

SEQ ID NO: 175 - DNA, 6069 bp, Glycine max
  misc_feature (6051)..(6051): n is a, c, g, or t
caaatcccatcctcattaatacttcacaccacaactgttaacaaacacgattaagccaaaaaagacaataataaatgagaagaaaaaaaatcaactaaatgtaattagttaaaataagcccaaagatacatgttctatctatacaagtttagtatctatacaactttttagtaactattcaactatttaacttattaatcaatccactacccttaactaaaaaaacatgtaacaagcaatgttaataacaggaaaaagaagcattaaaagtcaaaagatgaaaggatgaaatttgaaaatactaatgaatataaagaggggcaagtttagttatgtaatttgtaaagaaacaagcgcttgatggtaatagaaagtagttttgctctgagaggtatacaactatagacttccactactaaaaaaagtactttttacgactgctgatctaccttgccctttaacgtattattcgaccttatcattttctgatatattttatttttggtcatgtcatggtcatcaagcttcgtggttagcaacgggtacacgaaaagagaaagagaggaacaaggccaagtttggatgagaacctggtttttactggtaaaggatgatcctggtttttactgcattttttatgttctgatgtatttgcttctaaactttgtatgttgtcttatgacttggcctaggtaaatcttgtacagtcttctagcttttttattaatgatatctctttgcttaattgcttagaaaaaaaaacccgagtaataattccttttcaaggaaattaaacaatggattttctcatctagtaaatcccatatatgattttgttcatgatttgtagtttaacatttaattttttttattgcgtaatgcttttcaaaatttaaaacccacttgcttataatagtgttagtgagttgactaaattgtccacattattttttcaattttttaagggtctgttagtggaaagaaatgaaaaaaaaaattaaagtgagataaaaatttaaaactaaagtgtagaaatgtgaatctcactttgttgatttctactttcttttatcctctttttctccaaacaacacaccctaattgactaaagttggttgtgttggcagagaagccgttcttcacaatttttattttttttaacaaagtcacaacaaatgaattagttggttaacttctcacaaagtacacatgcatgtcttaccttctaattgcctctattaccattgaacaagcttatagagcttcatataattgatagagacaaaaaaaattatatcattctatgaaatatataaatttacgtgatgttatgtaagttttttttttttaataatggattgttttttttaaggtgaccacattaacagagcttatctggtttttgaaaatttcttttgaaatttatctgtggtcctgtatatatattttgtttgcagtaagaatttatctaaattatccattcagagttgtgtgtgtagcaaaaataggacttctgataaaaatgtgttttcttcaggtcattctttttgataatcttaaaaaattagtacatgtatcgtaagaggttatctcctatgatctatcacttctcgttcaaatttgaaaactttgttttgcatatttatgctgttgtttgatgggtaggacccattgaaggagattatttttggacatgattgtgatgatttctagtctgagttgcatatgtttggttgtagggaaaaaggtgagcaaaggtcctaagatacaacggctggtcactcccctgaccctccaaagaaagagggcaaggattgcagataagaagagaattgccaaagcaaaatcagaggcagcagagtaccagaaacttcttgcctccaaaaaaataagcctaggtatatggaatatactgatatactctgaaggtgtttataacagttaactggtttttattacttaatagttcaggtttctattttaacttctgagtgtctagttaagcattgctgctatagtagtgctatggaactgaggaagcttcaacttgcacaaaataatacttaaaaattaaatagtaacaaatttattaaataaaatttggagcgtgttacacgttcgctggacttggctcgatgcatgaagcccactgagcccaggagtgtaatactattgtttaaatcaaactgacatttattactaatttgctcttaaactatttattgtggcaatcatagtgtcagacagtacttattgtgcaaccaaaaaaagtcagtccttgttgtcttggttattgcactgcagcgctctgttctgaactgctcaagcactgaccctaattatactaccagatcaaaatacttcatacagtataataatatattttgcacgtgttagatgaacaatatcgagggtcttgcctgttttttatttcctgtgattgatgcatacagtactattttcattttaattttctacatctatctttcgtaatagatggtttttatttcctgtgacacgctagaagtcatctctacttgaaataccataagacagtagcattttttcttgacagagattcaaattgtccagtgcttgattggtattgcttccacttggaatactacttacaatatttttcttgaaatttagaagaaaacaaaatgattacatgattaagttatcattttctttatattatatgtttataacattttattttttcattttgtacccaatgtatgatattataagttatcaaattagtaattgctattgccaggtcattttgaggtccttccattctgacttttgtctatgtttacaagaaattcgttggttaaactatttctttgtgccttatagttcctattttaaattttagtcattgcacaagaaaattgtgacttgtagtagccatatgagaaaacattaagtggtagcctctacacatgcataagaatttttagtttatactgtgatgagaaatcgcatcctgtcatccatgtcatacagtaccatactaataagttctagaaaactcttagttatactcagttgttatgacttgaacctgaaaatcaattttttgttgtaatcacaggttcttgaattgaataattaagtatagttgggacatcgtgttcgattttttattgctaaaggaaaggatcaatatacctccaatacaaggtaatgttgaaaatctccccatactacatcggttttacgataaacgatgtaaaaagctttcattttctacatcgattgattgataaccgatgtagcaacgttaccatatctagtcattctacatcggttgaactataactgatgtagaaacctttcattttctacatcggttgactgataaccgatgtagaaatctaccctttcaacatcgtttcagcctgagaaccgctgcagaaagttacccattctacatcggttgtagctagacaaccgatgtagaaaagccggccttcaaagacggtcataaaaccgatgttgtgattcaacgaccccgggttaccaccacgcgtcataaccgatgtagaaaggtcgttataaccgatgtacaaggcctttatttttagtagtggtttggtgttgttacgttacgctttggtggtgacaaaaagcttgtgagctgcatgttctcccgcccatatttggttttttcaaacttggaatgtagttaaaaaattttgtgttttattttttctgttggtcataattaaattatttgttttagttttaggtattataaagtttggatgttatatttattttaggtattttaagttattattcaaatatatggtatgttagtttgtatgaatttggaatatatattgtttaaatttttgttttgttattttaaattattttgggtattctaataacaaaaaaccttgttactaaaacttcaaattaaaactttattctaataaaaaattaattacttcaaataaatatcatgccaaaaacttaaaaaacttgtacgctttcaaagtagaaattttaaaggcacatcaaaccatcaactaagttgctattataaataattaatcttaaaactaataacttcaaaataagtaaatataattaaaaaaatactacactcaaactttagattaaaaatttattctaacaaaaaattaattatatgatgcagaaacttaaaaaacttgaacgctttgaaagtaaaaattttaaaggcagaacggaaacctttgaaagtagacattttaaaggcagaacaaatcattaaagaagttgttattataaataattaatcttaacattaataacttcaaaataaacaaatctaattacaaaaaatactcgaaactcaaattttattccaaactcaaaataattactttaaataaataaaaaaatgccaaagaaattaataaataaaaatgatgccagtcgaaactcaaattttattccagactcaaaataattacttcaaataaataaaaacgatgccagagaagagaaattactgattgagagaaactttaaaaacacttagaacactcagaaatttttaaaggcacaaagcatcagcacgaaagcatcaacatgaagttgctacttaaagggcacaacacacctattttgtcaataccattggcgatatatgctccttgtttcgccaacactgattgcaaaaccaacttagcctgaaccctactgccctactgttatcctgtgccctttgcaccttgcctgcgccctctgcaccgaaatctccagtcaaagtggcaaaaactgtgccagctatctcgccagtgacactggcggaatagccacatgtccagtgcaggcgtatttcgccatgcatgctgacgatatacatgcatgctggcgatatacatgcatgcatggctgaatctacgtaaaaaagaaacccccttgaaaatagttttaaaacagacctattctgggaattagtttgtaaaactaaccccattaggtcaatttagcgatgtttggcatgccatcattttcattgtccctaattctcaccaatctcatacccaaaagattttgtcactttgtaacaagggagctgttactaagatttaataaaggaccaaaagtttgaacgataaactatacagtatttttaacaattttaatatactattattatatttttatttaatatttaagaatatttctataatttaaactcatgcattaagtataaattaattttatattatcattcactcatatatcatcattaatatgatttttaagataattatcataattattatagatgataaaatattattgaatgaagttttaaatttgttttacaattttattatataacttattttttctatttatcaacaatatattacttttatagcctcatttgttgtcctatttctcactcccacatataagttaactttgttttttcttccttgaatgttttgtcacattgtaacaagtgaaattgttaagatttttaaaaaagcaaattgtttgaataataaattaaatttcaaacaattttaatatactaatattatatttttatttaatatttttaagttttcttagtatttaagaatatttattaacaagacctcttatagctatttttttatggaatgactattttttttagtaatgactatttttttttagtaatgagaatcttgcatttctattaactcactataataatgatgatgacgattgagttaagttcaagtgaagcgattgtatgcatgagtgtaaattagcttatttagttgaccagactttccttataattcacaaaggttgttacagaaatttgaaatttaatgtatctaatctaagtatattaatgcattaaaatatatatatatatatatatatatatatatatatatatatatatatatatatatatatatatatatatatatagattttaatgcattaatatacttagattagatacattaaatttcaaatttctgtaacaacctttgtgaattataaggaaagtctggtcaactaaataagctaatnacactcagcatacaatcg

SEQ ID NO: 176 - DNA, 65632 bp, Glycine max
atttaggtgacactatagaatactcaagctttacaatcggacaaactggttactatacaactactatgttttttcttttcttttcttttaatctctgttcccattttatcacaagtatttcttttttgtcatttattaaaaaaaagtaaggaaaattaatactgtaaattataaacacatgccatataaaattgtgtaaaaaaaaaataaacgcatgccatataaaaacacatgtcataaacaacgttttaaattgtggtctctggtcagcagccacaattaaaattcggcgacccaattttacctacgacaacttcaagtcttccactacttaccacacaatttaaaaaataaataataaaaaaaaacataaaagcgtgtaaacgccactacactgaaattcagcaaaaaaaaaaaaaaatcagcaaaaaaagccactacactaactttagaaaattggaaggaaaaaaaggtatccacaagccaaaacttagattaagaaataactaaattaaatacttcaaagtaaaaacattaaaaaaaaccccaaaacagcaaataattaacaataacaaagcaacaaatcacaaaattactccaaagttctaatcaactgttgtgttccgtgcatccacgtatcaaactcacgcgtcaatttcaacacacgctcatcgattcgaaatctagagcatcattacccgcacttatcgcagagatcggcgaattcgccggatcgcagggcccagcctttgcgccaccgaatcgtcgtcgaggtggcgcacgccacgttcatgcagctccttgactccattttcaactccaattccacacagactctgcaaaaaaaaaaatcagaaaaatcagaacgaaaaaccctaactgtcacctcaccgactcgcgcgacgccggatgtaaaatccggctgcggagaagcgcccgtaccgaaattaagcgggagagcgaagctcgagtggttcctccggtcgccggaagttcacgaggggaagttccggtcaccggaagttaatttttaagcggaggaggtgccgcgaggggtgaggtttgggattcgcattcgcgcgttgtggagaggaataatgaagtgtgatcggaagattgtcggaatctgaacggagagaaaccggagagagatttgaatggacgatggtaaccggagagagagagagaagagaggggtgaaactgagagaaagagagagagagaggaggcgtgtgcatgcagaatataagaaagaagaaagacagcaccaaaatgcatgcacgatgattatacttcaagactcggccaactcccccacttgctccctctttttttaatttttaatttatcatcattattattattctttttgtagcttttattattagcaatatcattgtggttgtattgttactcattattttatcttgtttcttttttggctagataatgtttagtattaattaaatattaaatatatgttaacattttttagatagtaatgtatgaataaaatttgttgatatttaatgtgtgaaaatacaaatattttaaatgttaaattatgaataagaataaaattttcttacattcttaaatgagaataattttttagatagttaaattatgttttagtccttagacaaaaattttagcatttttttgtctttatattattctttgttaaaaaatttagttttcttttttaagtcgtagcattaattgatggcgtgactctgttaatgataaattatttgattatatgttggactgtcttggatttgatagtgcttggagaaagtggattaaagcaacttgcttaagttgtatgtctactttggtcaatggtagtctaataatggagtttctggatgaaagtggtctaaacaaggtgattctttggtgtctttttgtcccttataatggttaagggattgaatgacttagttagtaaatttgtggaggcaggtaggggttaaaggctttgaagtttatgactttatttccttttctttaatacaatacacaaatgatttgatgatgtttggtgaggcatattgggacaacttgtgggctcttaaagccattccacgaatctttgagcctgtctctggtttgaaggtgtactgtccagggttcacgagtgacatggcgagtgatgcagcattgagtagtccttattagccctccatcttggtcagccctagaccatgaacacagatgttctctagaaggtcaaccttagcgccacatggctaagtagttaggtcattatgatatttcgatacgcgagtatctggctgtcaaggtagttacaaagttgttgcaatgcggttacacctgactaatgaggttgttatgatgttgcaacaacctctcaggcaacaccctaggattttcaccaatcactataaataatcaggttctatattcactttaacttaaccttttactccctcctcattcctcaggcagaggatactgacagattcaccaccacgaagatcactagagtacccacactaacgacggacaactctgatgttagtctggctccaatttttggcaagtacaaaaggtaaactctcttaaaagcaaaatatatggtgttaatgagcatgataattttatggttatggcatcaacatttcttcattgttcgactgcaacgttgccttttatattccttggaatagtcattggtgctaatcccgagtgagctaccacatatgatccaacttttagcttatttaagaaaaagttgtttcagtggaaaaggcgttatttgtctttagggggaggcttactttgttgaattcgatgttgttatgttttcctttatattatttctcttgttataaagccccaaagacacgatgtagctccatgttgagcttgtaggccttggatcttcctatcaatggagtcctttgtttctttaagatcaatggtagcgaaatggagaagaagaaaaatgattggagacgtcactttaaggagaagatgagtcaagaacaagctcatcactataggaagccatggataagagtttgaaggtagaagaagatgagtggagggagaaggagagaaggagcacgaaattctgtgcctcaaatgaggtctgaactttgaacatgagtagataaaattacaaagatggtgtatgtggagtggttttttggagacaaagaagatatgttgggttaattgggaagcagcaagtctccctaagttaaaagtggttttagagtgaaaaatttgaagttgtttaatatcagtcttctagtttaatggaggtggcaaattgtgtctgataaagatgcaatatggtataatttgctttgttttaaatatgagagattgaattcaaattctagtagtaataattcagtcagaaatacatctaatgagtggaaggatgttatgagtttagacaaatgattgttggtttcttaatttagttactcaaagtgtaggaaatggcttaaggatcttgttttggaaagataaatggttaggtgatacttgtttaatggctttttttttcgtcatctttatcacatctatcttacacaagataacgtaatggtggatatgggtgtatggacatcatttggatggcagtgttgttggaaatggagatgtaggttgttctgttgggaggaagaattgaatgactagctgatgcaaactttgtttggtgttaccttggccaaggacaatcaagattcttgggtatagagtcatggtggctctcaacaattctcagtagcaactgcatatgctattttactcttgatgtaatagtaaacaaagatttcctaggatttctatcgaagaatttttggaagtgtgtgtccctttccaacatgtctttttaaggaggctcttacgagattggttgctaactcaggtggctttacctcacagaggagttgcaaacgatggtactagttgtgttgtgcttacaatttgtggagaccacgaatcacttgatcttccaaaatcacttttcttaccaagtatggatatgtgtgtatcaatggttggcattttgtcaggctcaacacaatcagatgcaacaacattatgttcaacgtaggttgttgtttaggggggaaagaaaatgtgtcaattttggtatatagtttggtatgctacatgctggtgtatatggttgtagaggaacaattttcacaatgtcattttagtggacctagtttaggtgtaaggagtttattttagtggtatttcttttgccaacaactattcttgttctatggaatgtcttaaagattttgtataattttgcattcttggtaggatagtaagtctttgctagtctataatatgatgtctctattacatggttatatatttcatatcctcttaataatattcaattttatgttgaaaaaattgacaacctgacatttacattgttagttacataacttgtcaccttattgatgattttgatatagaaaaatatgtgtaattttttttataaattatatttttagtcctgtgtgttgttaaaataattagtggtattagactaattgataaaagattaaaaatataatttgtcaaaaaataaaatttcataagtaattattacattagactaattaataacaatgaaagtcacacataactgttatttcatcggttatgggtgatacttgataattgagactaaaattgttgataaaaaaaataaaaggggtaaaaagctaaaaaaaaaattgtttcgaaactaaaagtgaactttacaaaaaatttagggacagaaaaaaccctgtatcctttataatcaactaagagatagattttcttattaaataactaactgtaataaaattaaacaattaataaatttattttacaaaatttattttaaaaataggattctaagacaaatagtataatttatttaattaaaaataaaaaagttccgtatgtcgtatacgagaaaggaagggttggtattttatttttatatataaaattattaatattttaaaaaaacatgttcactagtttctttatttaaaattataaatatctgtcacttgttcatttcaagctcttctctttaaataaaataaattctattatatatattgaaacatatgactttttttaacagaagttttaaaaaatatgacttaaaaaatgagaacacagttttgtttactttatatatattgaacatcaaacatttgaatatgatcgactttcataataataaacagtaacatattttttctcactctttattttattttttatttttatttttatttttgaaaaaatcaaatagaaagttattaattaattctaatgttttattaatacgttttttttatctttatatacttttttaatttttaaactgtatttaagtaataaaagaatttcttgacatgataaaagcttgatttttttcttgatgatactattcacatgacctttttataaacaatatataataaacaaataattaatatatttccttatcttttgaatgctatttattttataaaataaaatctttagtatttatttttaaattttttaaatattaataaaatgtgaaaaatacctataaattatacacgagttaaaatattaattatcaaaagcattaaagtaattttctcattctctatcgtatcactttatagtagtatttttttttctttcaaatttcttctttttaatgttttcatgcaccctattttggtattttaggttgaacgttatcagtacccatattaaaaaattcatcaaaaaaagtacccaaattaaaatatccaaaagaacagataaatacgcagaaatatagcgtataatggaaaatgcgaccgctagcaccggaaaatgcgccacttagatacagttattttgatgaatttactatagtatcctttgttagccacaacgtaggagcacgtattcacccgtcaagaggtttgccctttttcgtccaatttcgatttctatgtggacccaattaaatattggtcaaccttccgaacattgaagtataaataatattcatctttatcttttatctgtatccgtactatatctatatttatattacactgtaaacacagataacaagaatattacaatatatgctagtaaaatcatgtagttataatacttttcctccaaaatctatgctttttacataagttgtgtaataaaacatttaattattttttttacaggttgtacttgtgaaactaaaatgaaaagtaaaaatccttgttataaataatttaatttatacatgtgataaaataaaatgatttttatttaataataaatcagctactaactttttttgtataaaattaattcaaacatatgttatgttaatcaataaatatatttttttagtttttttatatttcgataataaatttctaattgtatgattatcacatacataataatacgccaatttttttatacgtgtaataatatacatcataagtttaatcaatgctcattattgtaaaatattttgatagaaatattcaatagggtttaattattttatcacatcaattttgtagaggaaatttatcccatcatcatcttaataattattataatctagcgataaaatgattttgtacaaaacatataaaaatattttacaataagtgagtgtacaagttactaaacaagtgtgtctacatattaaactccaataacaaagcaattaaaatttaatatttagataataatacggaaaaacattttacattaagtgcgtctacaaattaaacacaaataacatagcaatgaaaaaaataatatttacataatagtagtaattcggaaaaacatttttatattagtattaaaagctttgacagttataactgttacttaaaccttaaaagcttcaactaatattttcttttaacagagtttcaactaatgtgtttggttggaaaacttaattactagtattatggtttttttttagttggaagcacgtttttcagttgagtaagtagaagttattatgacgtgagtgtgttgtgtgatgacgagggtgacgcaaaagtaaaggaatcacgtcgagtcgacaggtaaaagacaatgacagagccatctccatctgagttagtgccaatcgcacgcgtgattgctgtgcctggatttaaaatataaaatacatttaaatctatcttttattatttaaatatttttatgtttaaatatttgtacattatcttatgatatatttatttatcaaaataaatttgcaaactagtatgttaatttttgttgtatcttattttaagttaacataaattttttaacttaagataaatttaaaaatacacagagatagtattcgaatacagtttactatttgcgcatgacctaacattacgtatggattatgtaatacgcaaccaaaaatatctcgcggattttatcggttgatctttgttcaaattggcgatggccgaaagtgttatcttcaacatccttataatgattatgataatcaaaagacattttattttgttataattcattaatgatagacattaaatatgatttaaatttaattctaaatctttatatatatatatatatatatatatatatatatatatatatatattatttttttagttgtgattcagttttaatattttattatcaataaccatgaaataatgttatagaagatgatatatttattcacagtttcatattaataaaaattatatttctattttcttaacatatttatcttgttgatactatttaatttctattgatcgtcaataaatttatttatttttctttctcgcatgattgtgttatttgtgaccttaaagcataatatggagatagaattaatcaacataagtcatttgataatataagttaagtttatggattagaatttgagtttgatttttgtaaaatacattctttttgaaaaaaataataatttttaagtataattaagtctcacttctaattgaaaattaatcttataattaattcaaataatcaaagtttatgaacatacattagaatattattgggaacctaagatcctaattgcatatggtgatactaaataaaaaaaatgtacatacttcttaaattcaacgctgatacattaaaaaaaatcaacactagataaaattttgagtaagactttttctaccaggagacatatgatttttattaagtttttatgtgtaaaaatttgacttaattatacttattttctcatgtatcattataatataattttattctctaattaattgagtctcctgaatattataagtgtgagattttaatccttttgatagttggcggcattgattgatatggtattggcattaaactgagatagtgattaatttggcatcttatttgatttttaatttgacttgtttgattttagtccttgggagttttataatcatgtcattttagtttttttgtattgcataatgatagaattttagttttttaaagtgatgtagactaaaatgatgaaaacattcataaaatgttatagtttgattcaatcccatgtcacacattaatagtgtttattaaaccactatacctataacatttttttattataggtatacctaagcctaaataactaaaattataatatataagttaaatacaataatattaataatatcatttttataggtgactttaagcaattaattatactattcattcgttaactattttcttaattaattattttataatatttaaatacatattttccactttactaataacactgtttagtttttttttaatacggctttgtactctcatatgctattgaatcgggaaaaacacaatacaaattaagttaatttatgcaaaacaatttttttacgagattatgtaggaaatattataaaatttctatgaatattttgatgagcttaagaaaattaacaaaaccaatgttaattaattaatttctaccaggaaaaaaaaaaggcagaagccaatgaaatttaaggggtacagcaaagatttgtagaaccatcattaatattagtgcaacataccatgatgaagtgcatgacataataataatgtggagccaattgtgataagaacagaaaataaattagtgtaattgcatgatcagaataaagagaagatatatcatgttcatattgatcagaaaataaggcaacatgttaaagaaatgtgccaggtgcaacaatgagggaacaaaaaagagaaggataataaagaatgtggttatgacttttacaaaatcgaattatttacttttttaattttttatattttcctttttactttcctaatagttgtccgattaagaggaatttatggagtagattagattgattttgaaaaagagaaatatcatcttatacaatttttggtttttttaattcattgttcaattgatgtagtttaaaatttaaatatgatttaatcagtctagattgatctcaattttaagttttaattttatttctatttttttaaaaaataaatatttaagatatataataattgtgatacaaagtaatttaaaatatttctccaaaaaatgtaatttaaaatatcacatatatataaatcattttaaagctaatagtaatatttctataaaaaaagctaaaagtatatctctgttatataagttgataattatatttatatatacttgaatagttactgaatattataattaattaaatttacttttcataaataattttaagcaatgtaatatatatatatatatatatatatatatatatatatatgcttgtccctgctatatgttgatttttttttttagaaaacaatgtttttgacgagtgagatgcgatatatctattattgatgaatatcattattgtcttgattagacttgtgttgtttgaaatcctagagaatgtgaatctcagacatgaaagatatatgtatatgcataatgcgacttattgttgatgttgttattgatgaatttaattgatatgtggtgatgttgacatttatgatgatattgatttgagatgacgttgttaatgatgatcatgtcaacatgaattgatgttattattgatgattatgttaatatgaaatgatgtggttgttgttgataatgtcattgagatgatgagatgttgatgttgagagtgatattgaaatgagatgttgatgatgttggaaatgcgttgagatgaagcatgttgtgtatgttcgtgatggggtgcattgaccttgtcggatgtccctggtaggggaaaataaagtggttaaagagtttaagcatctctgaggggatgacttaggatctttaattcattcatggtcagtgtacttgatggtgcccacattttatacgttgtatgttgtgtatgttcatgggggtgcattgactttgtcggatgtccttggtgggggaaaatagagtggttaaagagttgcatgtgtacgacaggatgacctcgacacttattgtcttgtttttctaagtgagagtgtcgtgtggacacgcttatgctatttccttggggatggtaccacattgcatctaagagttgagatcaggtgcatgcatcatactgaacatgattaattggaactatgtatgaatgatgactatttgttgagtgtgtgttgattaatgaatgttgtataagctcatgatatttgttaatgttttcttgctaattgtggttatttgaatttagtattagttctttttataatgaactcacccttgcaattttgtatcgtgtggttgatacttgtgatgatcgcgaaccttgttcgtgggagcagaatgacagcagtaaggtgcagaaagtgagattctgatgtgaagtcgccgaactgacgtgatgacgttgagattattttgagagagagttgtgttttgttaatcaactccttcatagttggttccataatttttttgttgaattaaggatgtaaatcacaaacttaattatatgtatgaacaaatttaccttccattgtgtgaatgatgtgtactaagttactatgcctatatatatgtatgtattcatttaagtaatgatgcgttgtttcggaatgtatatcgtgaaattaaaattactttaatttttcataagcaaattaatggagtttttcatttaaaaattgaaatttttcgcagtttagagtggtgatatcgtaacgaagaggcgggccattacaatgagtgaccatactattagaatgaaaataagaaaattaaaaagttgagttagaaattttattatattttattttcaaagttaatatgtaatatatattcttgtgaccaacatgttattgcttagagtgaaactaaatctgttgcaaccaagtgactaagtgactgagtacaagtggttagtgtatttaaaataaagttgaatcgtttgaatattacctgagttcggcttaacagaaataattattggtaagactttacttagcttgtgactttagcatcatttcccatgatgaactgaaaagttaagacaaatccccttgagccaagattttagatttaagtcttacatattaaaaataattgaaaatagtgacttcgttaaagatgaataactaaatttctctatgaagatgagttatcagtatataaaattaataaatactttgtattaatgtcatggaaacaaatataatttatacttagtgcatgagtttaaattatagaaatattcttaaatattaaataaaaatataataatagtatattaaaattgttagaaaatacattataatttatcttttacagcagataaaaataattgtgaggagaaaaaataaattagaggataaatatttataaaactttaacaaactaataaaaaaagttttcatttttagagttatgtctatttatattacatgtaaagaaaatttaaatttttatgagtagttggatctaggactttaactacacaataatcattgataccaagttcacttaaatttatctcaacaattgataaaaacttatatttcataataattgttgatttaaaataaaaaaaaatattttatagaaattatatttattaaatatcataagagaaaaatatatctttttttaaatataataaaatattttcatttgctcatcatttctttgttgacttaaattttctttctctctcattttactattgttgtttgagataatctcattatttttttttacttaactaacagtaatatttttgtatagataagatttgaaggatgaaatttcataaaaatataaatcaaacaattacaataaatatgtaacatataaaagtagagttgaattaaatgatgattttttatgccacaattttaaaagaattacttttattcctccctctagataccgaaaacaccaatttacttaagtagagtaaggacaagaccagatatttctgaactttttatcacattcccaacctgaaaaaaacatgaaataaaaaacattaatcacagaagcaggaatcaaatggatagaatagtttgtaagtcaagactaacgtgttgaaggggccatttgcccagctgactgactataggatgtgtatcagtcaaaaccttcaaataccgagatgggttaaggtaatgcaatctatagcttaaaaggaatttagaagtgaaaaataatgtttgcttcatattatatctcagtcaatttgggaacaatcttaaggagacaccgagacaaatgttgaggagcacggtatgccatagcaccaagtacttgtacactactttgttttgtcctccaagctttaacttcaagaccccgaacaaatagattagctatgcgatagttcatcgaaatagatgttatggatagtaatttttttaatttgttcaatttacatgctatgttggaatgaaattaattgaaaagaagcattgggctgtaaacaaggttgcatttcggtttgcagtatatttgtttgtactgacccatgatgttatgattgctctttcatcttgcttagcagtaaacgatacataatattgcatgacttaaaaagaaaggcacaaataaggagatttgatgtttgcttgcagaatgcagattgatttatgcttgaaggctgacaccttgccattttatctcctttattgtattttaacatgatgttttaatgtttattgaagctcatcatattggacgtgccactggtagtgggctagtgacaaggtctttgggtagtttgcaggtgatactaggttcaaacatttgtgcaatcatttttaagtaattgcatttcatttggactaaaactggtatagtttattggattgacttttcaaaaacaccatgtcaatgtgtgcaacataattaaattaatatagatgtaaataaaatctcaataattagtcaattacatcaataaaataaataatgtcttaacaaaagaaaatccaaacaataaatctaaaatatgaaatttaaacatctctaacaataaatgattccatatttgaagtagcttgaacattctccatctccacatttaagagtacaacaaaaatgaatcagtcccaacaaaaataggataaaaacaaattctagagagagaagagatgtactttgcgtggtggcacggtggtgggccgaagctgtgtcgctgtggtgtgtcgcgtgactgcgtgaatatgagtcgcgttttgttttccttgtaagggaaagagtgttaaatatgatgtgaactattttttataataaaaatatattgaaatatctttaaaaatatttatttaacaattatttttagcttaaatgataagaattgatatttttattatttatgacttgcaaatatgaaaatgatagattaaaagaaaaaaagatcgagaaaatatcaaaaaggaagatttttagcatgttatcacttatatttttttatcttaatcttttatttctgttatcttttatttttcttatcttatcttttttatctttaccatcttttaatttaaatcttttatttttacctttaaatcttttatttttacctttaaatctttatcttatataatatatttcttcatttgttattttaaaagaaaagtttaaagtgaaaaagagaaaatcaaacctaatataattgggtcagggtcacacaaatcaaaccaaatgcgggttgcgggcaacccgtggaccccgcggccaaacccgcatagtccgcgggttaagcggggcggaccaaaaaatatgacataaccatgaactgttttaaaaaattggttcgtaactcgagcggatcgcgggcgccacgggccagtccatggacctgggcccatttacccacccctagtctacaggttcctgatcctttgcgattaagagatgaaccctagaggcacatcaatggcctctatggaacttctcatcgaatgtgaagcatagcccgtgcttatggcgcgaggctaactcctccggggtgagacgcctgacggtcggagcctatggcggggaaggcagcaaagggggcaaaggcgtgatacgagggggaaccaaaggggctggtggtggagctaccaacggtggggtcgcggccgcggtggaggcagacgaaggtccgatagcttctgctcctggatcttcgcaaggctggcggcctggtccacagtcataggctggtggacctggactgtgcggcggatctccgacgtcaaacccgagatgaagcaaggcaacaggaagggggccgacaagccgataattctattagccaagtcttcgaactccttcaggtatgttagcactgaacccgtctgagtgagtttgaacaaggcatcgacaggatcctcatacggtgatgaggcatatcggatttgtgcaggaacagaggtggagtggcaagggactggtgtggggttgggcgtggtggaggaaggcacaggagcaaggcggttgcgaagcttgtccatattgagggtcatagagtgcatggtattgtcaagacgaacaagggccttgtcgaggttgcgtgaggccatgaggacaaacgagagcaccaattgttacgaactgaacataaatgcaggaaattaagagctggcttcgaggcaccagaacctccagaggaagaagaagagcagagatgagagtaatttgctaatttcattcatatcgtgctgcttattacatgctattgtatttatactgatttctacataacagattttgtccttttgtgctagaggaaatcagaaatcgttattcttgtctcccttgcttctagcacagatcattcagcatcattccttaggatcacacgtagtccttaaggtaagcaggcttcgagatctttcttttggtattaactgctgcttgcacctccttttctacttgatttacacccttctttgctatagacacccctgtagttgctatgtcttgattcacatctattttttctgaatacatccctttgtatgctatgctatcactcttccctatcagagggggtctctggttttgtttttcctaattaccattatgtaagatctagcttgtatccgccttcttcttcttcttcttattacaactttttcacaatattctttactatattagcatctaggccaacctgataagtcacgcaccaccataataataatatttaacttttttttattttttaaagaaaaattaattcctttatttttttaaatattatttttatattaaaatatatttagtaaaacagtaatattaaaaaattaatttatttttaatgtaaaaataatatttaaaaaaataaaggaattaatttttctttttttaaaaaataaatttttatttaacaagttaaattaataaatgaattttttgtttatagtatttttttaaaaatgtataaaaactaattatatatatatttttaacaatttatttatactggaatacattacatcataaataaaatacatgaacaataatatttatctaagaaaaaactgaagatgaagatatattgaaataattttttctgttatgtttttattatcgaaaattttcacatttttttttctagaatgaataccatagttgttaggtaaaaaaactatggtaggttgtaacatgtctccttcccaaggattaataatcaaatgaggttgataatgggaatgattcatgtgttagttgtttatgctttcattattttcatgtttcaattattattgttagtccattctgttatttttgctttattatatgttccatttatgatgtttgtctctttaatttttaatattttatgttatttgagtattttaatttcttaatataatataattaagatgtgataatcatatatttattgggtttttaatcaatctatttttttaatcactttgttttttaaatttattttaagattattaattaattattttcaaactataaataaataattaaacaaaaaatattctcattatttaaaaaacaaaataataataataaaaaatttagttatttttttatctgaaaataatatttaaaaaacaagtaaattatttttaaaaaaatataaaaaaagaatttaataattttttttaaattaaaaaataataggagcaaagagaagttgggttccctaaccccgacttctctctgcaagctaaaaaggagtgttgtttaggaaacaattttgaggcaggtgtattttggaaaaaatgaggagagagcaagtgtagtggagtaaaaaaatcctgtaaggttttgtttggtagtaaaaagaaaaaaataattgtaatgagaaaaaataagttagaggataaatatcttcaacacttaaacaaacaaataaaaaagtttttctaggaagttcacttaaatctattttaactattgataaaaatttatacctgttgatttaaaataaaattatatttattaaatatgataggagaaaaaatattttttacatatagtaaaatattttcatttgctgaacttaaattttctttatctctcattttactattgttgtttgagatgatctcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagataatggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacaaagagaatgggatcaaagaattgggaggactttcaaatcttcgtggtcgacttaaaattaggaacttggagaatgtttcccaaagtgatgaagcgtcggaggcaaggatgatggataaaaaacacattaatagtttatggttggaatggtctagatgtaataacaacagtaccaacttccaactagaaatagatgtgctttgcaagttacagcctcactttaacattgaatcgttgagaataaaaggctataaaggaaccagatttccagattggatgggaaattcttcctactgcaatatgatgagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatctcggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttagccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttgtccgattaagaggagtttatagagtagattaaattggttttgaaaaagagaaatatcatcttatacaatttttggttttcttaattcattgttcaattgatgtagtttaaaatttaaatatgatttaataagtttggattgatctcgatcttaagttttaattttaattctattttttcaaaaaaaaaatattaaagatatataataactgtgatacaaagtaatttaaaatattttaccaaaaaatgtaatttaaaatatcacatatatataaatcattttaaagctaatagtaatattttctaaaaagaagctaaaagtatatctctgttatacaagttgataattatatttatatatacttgaatagttactgaatattatatttaattaaatttacttttcataaataatttttaagtaatgtaataatttttatatatatatatatatatatatatatatatatataataaataaaaatataaacatcaatgatatcataaaattttggtaataataatttttaaaaaaaaattgtgaattaactaacctttcaggttctagagtaatttattaatccaaattgccttgaagcatattcccatgcaagtcaagttgagggacttgatggaggccatttctgaaatagagttaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggcaaggatgaggagactttatttcatgtaaaaaatattttcctaggagtatatatatgatatatgattatgttgggtcatatttatggtatctcaaggtttcaattgacagttttggctatctcggaaattttccttgtaccaaaatattaacaattgaaacatgtttcaaatccagttacttttggtaccatagaattgaaattaatttatttcaaatacattgtattcttaatatattaaatatgttaatttgttattttttttaaaaaataatcattagaaacaagttccggtataggaggcatacttagtgtttaggctaaggaataatgccaccgggttcaggaacaagcctgttgaggtgtcccttaacgttccgtgacatccccactcttgcatggacattctgtgcagagaaacgatgggtggatggaggtaagattgggtgagttctataatagtcactgatgagaaccccaagagcagcattgaagttcgaggaatccaaataagaccagcgtaaattatcaatttcatctcttaaatagtcactaaaataaaatataaattaattctttcaagtattgaaacattcttcaaattaatccttatacattgataaaatatttcaatgtatatatgcattaatggatatttaacactttagaaattacttatatatgattttgttattttaaggactatttataagaaagagtaatactctagatatcaaattggtagttaatttaattactcttgaaataagcatgctcaatttataatatgttgttttgttggcaattaaataagcacaccctctctagaatggtgtgtatgtacttttctgtatatgttgttttgtttgtatacttttgcttgcatagatcccaaaacaattgggtgattttcattcttctataaattttcttataaatatttaagaaatttttgctaacacaagactggtgatatgatgttaagattgacataacaaggacgtgagagttcaatttttcacatgccatgtcacccatcatagtaccttgttggcatgtattaagtcaacaacaaacttccattttaaccatatctttgatcaccgcaaaaaattattaaatttactattaaattgtttatatttatttttctttattgttgggctgagatttttttagttactaaaattataaaagtttttttaatctctgaattttgataaattgttctttttagtttctgatttaataaattaatattttataataattttaaaatgaaaaattcaatggctaaaaaataaaaatcaattaatggttgctaaaacctaaaggatgttgctaatcagtgccctaaggcattagttaataaattaaaataaaaaaatatttattatgaaaatcataagagtatgtaaaaaaaatcataaataatactattttatatatttcaataaaaaaattattattttagttctttataaccaattaataccttaaaaacactagttaacatttaccataattaaattaactaattttgaaataaacttcaattattcaattatgtcttaataagcttgatttttcccttactactgcaagtttgcatcctttattaaagtgaagtgatgaaatgttgtctgccatttacgaatatcactgaaattaaagttgttttctagttgaatttataataagtttttttaattgataaattttaatcgttattttgtgagtttttgttagtataaggaagtaaagtcacaaattttcttttctttcataattttttaaccatcccatcaatattatatctccatttacaataagttaataactagcaagatacccatacatttacgcagatcgctctccttttttacgcatattcaaaatacacttgcttaaaaaagataattagctatttagtatttatattcaataaacatgaaaaaaggattagaatattcaagcaaaaaaaaaatcaaaatcctaatttttaggctatttaaatcattgtcttctattatttgaaaattgaaactattattcatatttttacctgttttatcttcataaattctattttaatatatttattatgtatttatgtaaaaaaatcaacactattaaaattaatttaatttgtgatattattcagtatttaatattttgttataaaaatatatttaataaattaatattaaaatatttcttatataattatgaaaaaatgatatttaaacttattttataaatattagttaataaaatttccatatatgaagttattaaaaaaagagacaaaataatattttgtaataaacatattacctaattagatttaaattaattaatagtataaaaatttcaactacataacataaattattcaaaaaatatttcattcataaaattattttatacggtttctaagtaaaattgattttataggatttcaaatttttaaaaagatatcgtggattctttaatatgttgttatgttaaatattcttaaagaaaaagctttgtcacccataataattggcctgtaatgacgttaaacacgtgattgtttttcatgaatgatatttttggtctctatcataaaaaatatatattaattaaatgtattattgagtaagtattttaaaagtattgtattaaaaattatatttaataattaaattttagtagttattatatattatgtagaagtgattataaagtaaaaatgggttttcaaattaaaaaaaaaatattatttttactctttgatatacaattgtgttaactactaggcgaaagaactgtgtcatttgtaataattttgagtaggattatttctcatcaatgattattaagatccctgtcatgattaaaatgattttaatttatgatattattaagtttttgatatgaatttgtgtgaaatacttgaagaaagagcatattcagtaagtaacctaaaactattttgtaataaaaatacattttataaattgattttaatatttttattactacatattatgtaaaaattaaaattaatataatttatgattttattgagtaagtaatttaaaattatattgtgataaaaatatatttaataaaatgttatataattatgtaagaatgatttccaaataaaaataatattataagatttgaaagtaaaaaaaaaaatactatttcagttttttttatgtgtagttgtgttaactacttggataaaaaaaatattgtggtctataatagtctttggcaagattttcttgtcactaatcatatttgtaatctctagcataactaaaattattataatatatgatattattaagtcttttggtatgtagttttataaaatattggaagaaatagttttgttgcatataataatccaatttcgagtaggattttttcttatgaatgatatttatgatttctactacaaaaatatttaaactaattaagtttatgagattattgacgaaatgatttaaaattagttttaataaaaatatatttaattaattaatttttaacatagagtcaaaacattattttgtaataaatttgttaactaattaaaattaaatttatttatagtataaaaatttcaaccttataatataaatattaatgaataaaatatttatttataagattatttaattttattttatatgatttctaattaaaactaattttataaaatttcgaattaaaaataaattgttgagtctttaatatgcaattgttttaattactcgcgaaagagttttttttttcctataatggttggcccataagaagaattatttttagtcattatcccaaagagaataaaactaatttaatttatgctatttcttagtaaataatttaattttttttaaaataaaaatactaagtgactaatcttcctcaagaattctgagtgcacataatttgactattcccctcccaacccaatttatttcatacacaaggatcaacggggactaatatattaattttaatatatctattatatatttacttaaaatgattttatagaatttaaaaataaaaataattattattgaatttttggtttgcatttgtgttaactactcagggtaggaacattgacgtccataatgacattgagtaagattgtatcccatcaatgatatttgtgatctctatcatatttaaaattatttaaatttatgatattgttaaatctttaatatgtacttttatgtgtgtttcgttgcatttgcacataagatctctagtaggattattttacttgaatcatccaaggttgttaaactcatgttttaaatcgtagaattgtatgattttacgattccactaagcttcagcgagttaaatcgaaagcagaattgaaaacggaatagactcatctgatttagcgcaaacttgggcgagtttgggtagactcgcgagtctgctacgagtatgtggatttacgaaaacccgaaacggtgtcgtgttgtagctacttatttgagtagactttgtctaccttgttcgagttatgcaaagtgcaaaattgtttggttcatgcttcttggcttcttgctgtgatgcagtcggtgctagagtgctacggtggggtgcgacggtgaaaggaggttttcggtgttggagtgcgactgtgcaagtgtgtgacacagtgcttctggatcttttgttggaaggaggttttcagtgaaaggaggttttcgatatatgggatcaaggtgatttgttgcgaacaaaagctaaacttcaaattgcacagggccagttaaggaacaaaagctatactgatatacgcagttgctagttgttcttcaaattcagagtaaaggttttaatttggttctgggaagaagctatacaaggtttgttgttgtaataacttatgctgattgaatatttctgaaccatgggcctttattcctgttatttactgttagaattggatgaatgcagtctcatgaaccttttgaatttattagatttttcaagaaatttgtgatcatgggtttgttagaaaaaaggaagtgtcctgatagtttgtaccttagaaagtgagaatattgatatataggaaagtaatagtgagagtattgaagatttgatcaccattttatttggtttgaaatggaggcatttcgtgaaaaagtagagtgcagaatgcatagagttcctcagaatttcgcatgtgttgatgaagctttttgaagcatggtacacctttaagggcatactactgttgggttcatatattttttggtttaatgagagaattgaagatttgatcaccattttatttggtttgaaatggaggcatttcgtgaaaaagtagagtgcagaatgcatagagttcctcagaatttctaacatactactgttgggtacaccttgaagcatattcccatgcaagtcaagttgagggacttgatggaggccatctctgaaatagagtcaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggaattgttggacaaggagggtttcactactgacaaactgctaactcagttggagaatgttgtgtaagtgttaatgcaaaggacaataccgaaatgcatgaaaagatcatcatctcataacagactctttcacatacgaccgaccacctcaactgcaatggcatattttggtgaacgaaattgttctgactcacgtagattcaaagtgaatattcataaatcaggcattttctttgctttgtgacaatgtcactaaaccttcaattagttgatcttgttctagctctatagggtaataaaagtatatcaatgtctgcaaaatacatcaataagatcaagacaccaaaatatatatatgtgcttgaattatttataaacttttattttgattccgggttacaacttatcttaaaatattttcttttttctctgtttcttctttcaagtttttaatttaacttcctgggtaatctagattccataaaatacttctggaaatgcagatatgatcttgttttttttttttgtattttactattctatatattttatattagtgttgtttattttcttaaaattatcatacataattatatatgctatatacttgttgatagggaagaagatagaagctggttttcaaggaccagggcctccacggagagaagaatgagaagaataagggaaggaacaattgtatattccattgattgatgttgttattacatagtattatttatactgatttctcaataatcgaatttgtctttttgtgctacagaatatcaggaaattgttaagtttgtctattcctacccgaccagcatcattcttccagatatgatgcacctgcttgtttcacacctaatccttgaggtaagtgggtcttgtaattgctctcttggtcttgttttctaattgcacccccttgcttctgttgcttgcttgctgcaagttcccactgattcaaattccaacagttctgcaaataaaattgaagaagaagctagaggtgggaaatactcaagtcattctcttgaaaaagttgctgcaatgatatgcaacaaaatatcactatacggagtcaaggtaattattgtgttcacatgaacatttcttccatgaaaatatatatttttttactttgtaatctctttatagtatgcatggaaaattaattttctgatttttttctctgtagtgttatatattatttttaatcacattttcttatttattagtttgtttcttatttgacatcatgtaaatttggagatttgggttagaaatgtttttggaattttcctggttagaacttgataggtccataatgaaggtatataaaaggatagggaaaagagggggtggggaatagaaaaagaaaggacaaatgggcctcagaaacaagacatgcttgtgtatgacagcagaaagaatcagccgtacaagttgcactagctgaagtggaaaaggaacataggttggcataatggaatggatagcatttgatctttaataaatttttgctttgtaataggttcctaatatttaaaaagttttgtttgaaatacttatcattagtcaaaatctgttatttgctcacacgatcgttaaccagccacacagacatgtcatgtgtgatttttgtctgactgagattaggattaatgataagaaactatagtcaaaatcccttgggcataaaagaatcattcttcagcaaataacggattttgactaatgataagaaactatagtcaaaatcccttgggcatcaaaaaatcattcttcagcattcctctacgttttcacacaacccattatagtttcttctatacctttcttatggatttgtcactatgacttcgtcactcgtgaagatccaaggtgaagaggtcctcaccaacgatttttaggatcttgcaatcaattttacattttcaaatcaaaccaagccaactcccaactcaagaaattcacatggataaggtttctaagagaacacatcaaaatagtttcatgggtagaagaaggtcaacaaaaccttaccctaaaatgcgattccgctcggtccattgcatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcggccaccactggtgttgccagtcgtgccactgctcgtgccagcgccagctaccaccagtaacttccttcaactctcaaacctcacttctctcccagtctctctctcacacttggccctcaaactcacttgtgtgtcgtaggtgaagagaaggaaatgatgaaaacaaagaggagggttttctttggggaaggggggtccatgagtgattttttagagaaggagatttgttgttgccatggggagccatggttcaagagaagaaaaaaagaaaatgggttagaattattgttgtgttgctgccatggggtttcaagggaggtttggggggttttggagacacaatagcggtggtgtggagctagtggaggagttggttggggactggtgggggtggtttggaggattcggggacttaatgatgtcgtttttttacttttttctataaaaaaataaaaaatcttacgtgatcggttatcgatcacatatgaagataatggatttcgactaacggcaggaacttcgaacaaagctttttaaatattagggacctatcacaaagcaaaaatttattagggaccaaatgcaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatattttctgttcgagattgattgaaattatcttatttgcttaacatattaaaatgcgtcatttttaatgatattattggtctatagtttttatgtaatacatttaataatgtttagaaatatttgtatataaataacttttatctattttttcaccagagcctatgaaatgtaagcacaggtttgttaatgagtagcacaacatggacagtttgtcaaaggcccaatagcatctttaatgggattcttgaactcaagaaccctatccactagatctactattattcttattaagagttttttaagatggagattgggttctaggaaaagaactactattttttcaaaaatattattttttcttgtgctagtaaaatctaataatccaaattggattctactattagaataacaaatgatagaagttcttgcatcctatataacatcatgggactcacaaaaaataatccaagaacctaaaatggattctttgacaaaaatgttctaagaatctcaatattttcccacttaagaaatataactatcaaatcaatataatatgaaacgagttcaatctttattgattcacttgacgcaagctatatgcacaactgacataatagattttaattctaaataacatgcaataaaaatataacaaacctgttccggaaaaagcctcctcaaaatgaagcacattcagtccccccacaatttttacaagttggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaagataaccccttagcttcaagcacacagtgcgtaaaagctaaagatgtagaagatcggaacatgatccgatctagaccagaacaaaacctaaaaccaaactactaactgatctataattttttatacatcataaaactaaaaaaacaaagcaaactaagcacataatcttacaatccctactgaatttactaaaagagacacagatagttgaggtgggaaatgttgccaaaccagaaatgaattatcacgggaaagtatggctgatgtggttacaattaggagtcttaattcatcttaaagcattaatattttttaacttaacaaatataattaaagagaagtaacgaataagataatgatctaaaattcttgtattgattgaaaatagcgtaaaaagatgtttcaaagataatgatacaaactctttaaatgcaaatggttacatgcacaaagcacgtatatatatatatatatatatatatatatatatatatatatatatatatatgaatatatctacgtacattcatatatgtatgtatatgcaaacatatatacatggatgcatatatatatatatgcactaacaaacatatatacatctggatagagagaggatcagaatagcaggacaaagacaaacttgtatttgttgcttccatactagaattgcattttcttcagggttagatgcatcaactgtgtgggagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaacaagctttgtcgcattgaccgaaaaaaccaaggtgacgttgaccaaaaaatagtcctgacaagatgttggtaaaaaaatataatcggttgatatcgatcacaaacatcattgactaaggttaacaaaaaaatttctaaccgacattgatcaaaaaataacttcgaccaaggtcgatcaaaagaaacgtaaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccatttttttatgtatgtaatacggtaacacatgtacctcttgcagagattggggagaaattgcaacttttctttttacattttgccttaaaaaaagtgttcatatttataaaaataattttctatttaacttggatattttttctcatactactacactaaggtatatacaacctaaggcgtgtttcttaatttggagagtgatgcttgattgattgactaccaacgaaggataatctaaaaaggagaaacaccatttataatcctcatgagtgcttatgtcccttttgccttgaggtagatgagtcggtatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaagaaggaggcagatgtatggagggcggtgtgggcatcagaaattttggtgtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgccgcatcaatgttgcatggctttagacatgattttaaattgcaattatgattgcgttgcatgcaacgaacctaaaaatcttacattgtggataattatggaaaaatacaaactgatgtgatcataattataattgtgatgtgattacagagtcaaaatacattagcgttatgactgcaattatggttgctgactacattttaaaaccatgactttgggtgtaatggtccatgttcgaagctagctatctttctttctactgtcactggtgtatatgtttttggatcttaggtaattttggtaccatttaatacaaatcattttgttggaaaaaaaatacggtagcctacatgcaatatacaaaataaaattgaattactatatattatcataaatagtagagtataagaagtaaagaaaattctaaagataaacatgcatttaaaaacatatgaaagaattttttaactatatatataacatctttaattagcttaatagaaatgcgaaagtacaataaaaaagcaaaaacataataggcgtgacaaatcggttgcttatatacaataaagacaataaagtttgaaactaaaaccttatccagactatccaaatatccctaattaatcatgaaaaaattagaacagaagacatttaataactatagcaacagtaacagcagcagctatagctaatggcgcgatcaccgaatcggaaaacttttcatcattgaagtattctatttcactaaccctaagcaagatctcaagttgatcgcgtgcaataagagctggcatttcaatattgaaaaacctctcaattgagtctgcaagatctttaattttagttttccacggtaagaattcttagccacaaaattgtatttccctatttttgaacacttgtaaacaacctctttgctcttcctcaatagttgtatcagtggctcaagttcctgctgtgaacgacccaacatattcctgtacttacctatctcctgccatgtttacgctacatattttctagaatgttatttgaatttcattaaaaatcataagaagcaagtttgaatttttcagtgaaatttttacttaggtttagttagacaaaccctatttaaagctatattgttttgcttatcggaaccaaaccaattagttcggtttgaatttcttagttaaatcaagtctggcttaaaccaaatcgagctaaccctaggttaattgtttcaaaggtcgggttgaagctctttaaacttgagaatgtgttctacaaaccgaagtaccttattatttaaagaatatctaatatttttttgtttttacattattgttgaatccattttatatgattttttttttacaaaatattaaactttatttactaaataagatttatataaaattcatgaaggtaaaagtaatatttttatcttttaatgtaaggcttggtttcactttcgtccttcaacttttttttatttgatttatttcagtgatcatttaatatttatggattcttccttaaggaatcttgatatttttctatagttttaattgttcttcggttatttattcggaaattgagaggggatcatcacctccaaagatttcctcgctcccattaacaaaaatgtctaaacaattaccttccttctaaaatttttgtgaagtacctccactaattaaactcaacatattctcccaaacttcattttctttgaaaacaatgttgtctaattcaagacgctttgatataaaatatttagtcgctagaacgagaaaaaaaattgaataaaaagaagggatttttttcttcttaatgtacttcatgctacttatttgttggcaatcattattaatatatattatcttatatgagacaattttcaacatttaaatgttaattttgtaagtatcttggtagtatccttttttgataaggaatagatattattttgagattatattatgatgatgaattgtctcataaaaacacgaggcaagcacttgaaaggaacaaattctctaatttcttagtgggtagtgggagagaggaagtaaacttgcttcaatatgcaaatgacgcttgacgcactctttacaggagaagcaaccatttctaaggtgcttaccataaaaagcattttgagaggctttgaacttgtctcgggcctcaaaatgaatttccatcaaggcttttgtggtgccttgggagtggatattgataccttgatgaattatgcaagcttgttgatttacttgagacaaactatatgcacaactgacaaaatggactttaattctaaatagcaataaaaagatatataataaacctgtttcagaaaaggcttcctcaaaatggaggctacttcaatctagtacggtagttgacttactaagtacgaaacaacaaattattaagttgataattaattaaacatgattttaaatacttacatatttattcacatgtaactataaagatttagtaagagcataaataaaaaatgttgttataatatataattttaaatttaatataataaaaatgtgtttgcaaaatagaaatataaatataaagcgtgacaacacatgtttttcgttaataataataataataataataataataataataataataataataataataataataataattacaaatgggttttgacaaaatcatacctggcgaaaatatgcagtttagtgacggaattaatttgtgattcatgcaatacaatttgtaccaatcatcatcatcatcataatctctttttcgttttatttatcaacgttgctacttagtacgaaaattatttgcacaaaatacaaacagaatgatgctatctgttatgaaaggtaaatccacacgaattacacgaaatatagaatggacggttatgattttataaaatgaatatcgattaaaaaaatttaaaaggcatgtaaaaagagatttacagacatcaaacttcgtgcgacttttacaaaatcctctttcctaacacagcattatattttccatacacaaaccgtaaactatagattctaaagggtatacctgacttattaacaactttttaaaaactaatattcattaaaaataccaaataggttttgacataatcacacctcgtgcagatttgacaaaaaagaattcttacaatttatttttcctcaaattggtgttaaaattaaatatatgtgactagtcaagtaggtgataacaagttgcagcacttgtatatatgagtgatgcaaaggattcgtgcaatttatttacgaaaattatatattggcatgaaacacacgaactgtaaactatatatagtcactaacttgtatacgtacgaactgtaacaataaattttaaaataaaatattaattacaaatataaaatgggttttgacaaaatcgatcacacctcgggcagatttgacaaaagataattcgccacgaattctttttcgtcaattatttaacacaaccttccttttacgaattgcacaaatccacttttaaaatacaagaaaattttgttttaaaaattcagccagccgacatagaggtgtatgcaggtaagtttggattgagtttcatcatacctatgacttaagaatgagttgatttgagtcatttgtatacgattttaattaaattattgggttaaaatatttaaatttgtatgctatttattaaatccaatatttatataagctaaaattcttattaattagaatactgaaaacattacttataaattaaatattgtcagatgctgcgactaagtgaggtggtggaaagatgtcaagagttgaactctaatttttgaaagaataacaatgacactcggtacttattcaactctcttgttatgcacgaaacatatatttaataataaattcacgcgcgtatttataaaattatatgagaattttttgtataaaaatttaaacacataaattatattaaattaaaatgttatggtaattttaaaatatgaatgataaaatgattcaattattatactttaatttttaaataaaaattgatttttataatatttaaagtttataaataatattttgaataattttacatataaattaattaaattaaatgcaaaaaactgaaattaaatatttcttaaaactaattaattattatatgaatcactttatattagtaattgcgagctgcttgtctcttctctcccaacggctcccgccattcaaagtttggagataattaaaagcaataaagtagcactgcattcgttacctctcttggtagagactatagaagtagaaggaagctcaagggtttttattttaaaaaatatataaaaaatgaatttaataatttttttaaattaaaaaataataggagcaaagagaagttgggttccctaaccccgacttctctctgcaagctaaaaaggagtgttgtttaggaaacaattttgaggcaggtgtattttgaaaaaaattgaggagagagcaagtgtagtggagtaaaaaaatcctataagattttgtttgatactaaaaagaaaaaaataattgtgatgagaaaaaataagttagaggataaatatcttcaacacttaaacaaacaaataaaaaagtttttctagaaagttcacttaaatctattttcactattgataaaaatttatacctgttgatttaaaataaaattatattttataaaaattatatttattaaatatgataggagaaaaatattttttacatatagtaaaatattttcatttgctggacttaaattttctttatctctcattttagtattgttgtttgagatgatctcactaaatatattttacttgactaataataaaaattttatatagataagattcaaaggataatcaccaaccaaaaatttttatggaagtatttatcaaataattacaatagatatataacataaaaaaagagttgaattgaataataatttttcatgccaaattactttaatcactctatattattattattattatcattattataacatcttcacaatattctttattttattagtatctattatttattttattaattttatttaataaaaaatcacaaacttttctttttgcacacatctttaacgtacatataaagatattcaaatcttgaattcattaatattatgtttttagggatcaattagcatgtgtcctttctttaattctttctcttttaatttgttcaacattttttttgtcttaataattttttaatctcatttttttattttcctcctaacaaaatttattctatatataagaattaataaaaatttaaatcttttaccacttgattaaaaaacataaatcattatcaattattttaaatttataaaatcatgattcagtattagatctttataaaataccatatctctatgacaattttaatgattaggttgaaatataaactaacacgaatttaagtaaatatttcactatttactttcacattgaaaaattgattttaaattttaactttagaaaaaaaattctaagttgaggatctttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagataatggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttcagtgtttggggctctgacaagttgaagtcgttgcctgatgagatgagtactcttctcccaaagttagaagatctcaccatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttagccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcataatggaatggatagcatttgatctttaataaatttttgctttgtgataggttcctaatatttaaaaagttttgtttgaaatacttatcattagtcaaaatccgttatttgctcacacgatcgttaaccagccacacagacatgtcatgtgtgatttttgtctgactgagattaggactaatgataagaaactatagtcaaaatcctttggacatcaaagaatcattcttcagcaaataacggattttgactaatgataagaaactatagtcaaaatcccttgggcatcaaaaaatcactcttcagcattcctctacgttttcacacaacccactatagtttcttctatacctttcttatggatttgtcactatgacttcgtcactcgtaaagatccaaggtgaagaggtcctcaccaacgatttttaggaccttgcaatcaattttgcattttcaaatcaaaccaagccaattcccaactcaagaaattcacatggataaggtttctaagagaacacatcaaaatagtttcatgggtagaagaaggtcaacaaaaccttaccctaaaatgtgattccgctcggtccattgaatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcagccaccactggtgctgccagtcgtgccactgctcgtgccagcgccagctaccaccagtaacttccttcaactctcaaacctcacttctctcccagtctctctctcacacttggccctccaacccacttgtgtgtcgtaggtgaagagaaggaaatgatgaaaacaaagaggagggttttctttggggaaggggggtccatgagtgatttttgagagaaggagatttgttgttgccatggggagccatggttcaagagaagaaaaaaagaaaatgggttagaattattgttgtgttgctgccatggggtttcaagggaggtttggggggttttggagacataatagcggtggtgtggagctagtggaggagttggttgaggactggtgggggtggtttggaggattcggggacttaatgatgtcgtttttttacttttttctataaaaaaataaaaaatcttacgtgatcggttaacgatcacatatgaagataatggatttcgactaacggtaggaacttcggacaaagctttttaaatattagggacccatcataaagcaaaaatttattagggaccaaatgtaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatatattttctgttcgagattgattgaaattatcttatttgcttaacatattaaaatgcgtcatttttaatgatattattggtctatagtttttatgtaatacatttaataatgtttagaaatatttgtatataaataacttttatctattatttcaccagagcctatgaaatgtaagcacaggtttgttaatgagtagcacaacatggacagtttgtcaaaggcccaatagcatctttaatgggattcttgaactcaagaactctatccactagatctactattattcttattaagagttttttaagatggagattgggttctaggaaaagaactcctattttttcaaaaatattattttttcttgtgctagtaaaatctaataatccgaattggattctactattagaataaaaaatgatagaagttcgtgcatcctatataacatcatgggactcacaaaaaataatccaagaacctaaaatggattctttgaccaaaaatgttctaagaatctcaatattttcccacttaagaaatataactatcaaatcaatataatatgaaatgagttcaatctttattgattcacttgacgcaagctatatgcacaactgacataatagattttaattctaaataacatgcaataaaaatataacaaacctgttccggaaaaagcctcctcaaaaagaagcacattcggtccccccacaatttttacaagtcggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaacaaaacctaaaaccaaactactaactgatctataattttttatacatcataaaactaaaaaaacaaagcaaactaagcacataatcttacaatcccttctgaatttactaaaagagacacagatagttgaggtgggaaatgttgccaaaccagaaatgaattatcacgctccaaattaactttggaagccaacctgcacatacgtgtcttcatgaagagtatgctgaagctggatcctccaatcttgctccagcagtgagctgattaagttgatgagggtagcatacgtgaggatgaaacttgttggttaattacttaatttcttcctaggacgagtctaagaatcagactcaaactaatagaagcctagattcaaggcatgacagagaccataaaagatggcatggagttcagccttgagattggtagacactccacacgatcttgatttcatattttttttcttaaaataactacatacatattaagtagcatggttttaaattatgattgtgattactttaaggtgagtcataaaatctttttatatattgcagctaatcactggaaagtatggctgatgtggttacaattaggagtcttcttaaagcattaatattttttaacttaacaaatataattaaagagaagtaactaataagataatgatctaaaattcttgtattgattggaaatagcgtaaaaagatgtttcaaatataatgatacaaactctttaaatgcaaatggttacatgcacaaagcacgtgtatatatatgtattcatacatacatacatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatttgaatatatctacgtacattcatatatgtatgtatatgcaaacatatatacatctggatagagagaggatcagaatagcaggacaaagacaaacttgtatttgttgcttccatactagaattgcattttcttatatcaactgtgtggaagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaaccaagctttgtcacattgaccaaaaaaaccaaggtgacattgaccaaaaaatagtcctgacaagatgttggtaaaaaaatataatcggttaatatcgatcacaaacatcattgactaaggttgacaaaaaaaattttaaccgacattgataaaaaaataacttcgaccaatgtcgatcaaaagaaacataaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccattttttatgtatgtaatacggtaacacatgtacctcttgcacagattggggagaaattgcaactttttttttacattttgccttaaaaaaagtgttcatatttataaaaataattttctatttaacttggatattttttcttatactactacactaaggtatatacaacctaattaaggcgtgtttcttaatttggagactggtgcttgattgattgactaccaacgaaggataatctaaaaaggagaaacaccatttataatcctcatgagtgcttatgtcccttttgccttgaggtagatgagtcggcatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaattaagaaggaggcagatgtatggagggcggtgtgggcatcagaaattttggggtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgcgcatcaatgttgcatggctttagacatgattttaaattgcaattatgattgcgttgcttgcaacgaacctaaaaatcttacattgtggataattatggaaaaatacaaactgatgtgatcataattataattgtgatgtgattacagagtcaaaatacattagcgttatgactgcaattatggttgctgactacaatttaaaaccatgactttgggtgtaatggtccatgttcgatgctagctatctttgtcgagatagaaatataatctaaccatggaatttgctttctttctactgtcactggtgtatatgtttttggatcttaggtacttttggtaccatttaatacaaatcattttgttggaaaaaaaactacggtagcctacatgcaatatacaaaataaaattgaattactatatattatcataaatagtagagtataagaagtaaagaaaattctaaagataaacatgaatttaaaaacatatgaaactaatatatatatatatatatatatatatatataataataataataataagagattgttttaactatatatataacatatttaattagcttaatagaaatgcgaaagtacaataaaaaagcaaaaacataataggcgtgacaaatcggttgctaatatacaataaagacaacaaagtttgaaactaaaaccttatccagactatccaaataaccctaattaatcatgcaaaaattagaacagaagaaatttaataactatagcaacagtaacagcagcagctatagctaatgccgcgatcaccgaatcggaaaacttttcatcattgaagtattctatttcactaaccctaagcaagatctcaagttgatcgcgtgcaataagagctagcatttcaatattgaaaaacctctcaattgagtctgcaagatctttaattttagttatccacggtaagaattattagccacaaaattgtatttccctatttttgaacacttgtaaacaacctctttgctcttcctcaatagttgtatcagtggctcaagttcctgctgtgaacggcccaacatattcctgtacttacctatctcctgccatgtttaccgctacatattttctagaatgttatttgaatttcattaaaaatcataagaagcaagtttgaatttttcagtgaaatttttacttaggtttagttagaaaaccctatttaaaagctatattgttttgcttatcgaaacaaaaccaattagttcggtttgaatttcttagttaataaatcaattttatatgattttttatacaaaatattaaactcaatttactaaataagatttatatcaaattcatgaaggtaaaagtaatatttttatcttttaatgtaaggcttggtttcacttttgtcctttaacttttttttatttgatttatttcagttatcatttaatatttatgggttcttccttaaggaatcttgattttcctatagttttaattgttcttcggttatttattccgaaattgagaggggatcatcacctccaaagatttcctcgctcccattaacaaaaatgtctaaacaattaccttccttctaaaaaatttgtaaagtacctccactaattaaactcaacatattctcccatacttcattttctttgaaaacaatgttgtctaattcaagacgcttcgatataaaatatttagtcgctagaacgagagaaaaaaaattgaataaaaagaagggattttttttttcttcttaacgtacttcatgctacttatttgctggcaatcattattaatatatattatcttatatgagacaattttgaacatttaaatgttaattttgtaagtatcttggtagtatccttttctgataaggaatagatattattttgagattatattatgatgatgaattgtctcataaaaacacgaggcaagcacttgaaaggaacaaattctctaatttcttagtgggtagtgggagagaggaagtaaacttgcttcaataggcaaatgacgcatgacgcactctttataggagaagcaacactttctaaggtgcttaccataaaaagcattttgagaggctttgaacttgtctcgggcctcaaaatgaatttccatcaaagcttttgtggtgccttgggagtggatattgataccttgatgaattatgcaagcttgcttatttacttgagacagactatatatgcacaactgacaaaatagactttaattctaaatagcaataaaaagatatataataaacctgtttgaaaacggaggctacttcaatctagtacggtagttgacttactaagtacgaaacaacaaattaatgagactgctgactactgatttcatagaaagatttaggaagatgaggagtaagaaatgtatggtaaagcttctaggagtagaatatgttactatgtcttaaagtaaaaaaatatttatgtttaaaagatgaattatgattcataattattttaattaaatataaataataaaagttatatataatatattattggatcataatttataattttatgtttgtattttcagtcaatacatttataaaacaatttagcataacatttatgaactaaatttaaaacctttatttaatattttaagattctttcattagaaacaagttccggtataggagttggtatcctttcaaatgatataaagcaatagatttaaattttatattctattttattgtgtcaaaataatgtattaaattctttggtaagagacactataattttaagttattaagttgataattaattaaacatgattttaaatacttacatatttattcacttataactataaagatttagtaagagcataaataaaaaatgttgttataatatataattttaaatttaatataataaaaatgtgttagcaaaatagaaatataaacataaagcgtgacaacacatgtttttagttaataataataataatattaattacaaatattaaataggttttgacaaaatcatacctggcgcaaatatgcagtttagtgacggaattaatttgtgattcatgcaatacaatttgtaccaatcatcatcatcatcataatctctttttcgttttatttatcaatgttgctacttagtacgaaaattatttgcacaaaatacaaacagaatgatgctatctgttatgaaaagtaaatccacacagaattacacgaaacatagaatggacggttatgattttataaaatgaatatcgattaaatttaaatgttatggtaattttaaaatatgaatgataaaatgattcaattattatactttagtttgtaaataaaaattgatttttataatatttaaagtttataaataatattttgaataattttaaaaataaattaattaaattaaatgcaaaaaactgaaattaaatattgcttaaaactaattaattattattatatcatctgctccattataattgttgtgtaaaaaataataattctaaaataatttttatttttattttttaatgtaaaattaattatgtttttttacttatatttcttatatatgaatgatgaactacaaaatttaaaaataaattattgatgatataaagttaattttataaaattattttttatttttttatttatataaaataatgtatgatgataattattttcagaagaaaagcaacacttttctaagataaattgttatagatgtttaatattatattttgcttgtaagacaaaaacatactaactactaaattatctaatttatgtatatttttagtcctttgcataatcgggcgataacttatcatatgaaagaatactgatgatgataaatactttttgaagaataataatttttatgaaatatttgaattagttttacattaagagtttctaatgatcttaaaatgattaaatgtattatattatatttagtaatatacttaaaaatttaaatattgttgtaattttaaaatatgaaaggataaaataattgaattattttacaatggtatttcaaacaaaaataaatagttatactttttttttataatactagtatatgtataaaatagaagaagatagataaataatacaagttatatccaattactacaagtacgcaccgatcaatttcaataaaaaaaaaaaacaaggtgtgagtgaagtcaacaattaagatagaaatgaagttggaagaatcatcgattttaagattgcattatatgctaataattgggctgactatatatacccaacaattaatgttgttatcgttgttgtgcttgtctagtgaatgatggcagatgttgtatttcaaggtatgggaactgcgtggcaatttctgaacgtgattatggtcataaaagacaaagttacgttcaaaacagcattggaaaacctccaatccattctaatacgcagcttgtttctgattgttccaaagtccacagcttaaattttgtggccaggcatcgttacaatgttaaactaaaggcatttacaaagtcatttcggaatatttactccacggtcatgttagctcagattgcaagagatcaaaaagagaaccgtaggagtcaaatactacttgcctacaataatcctgctcagtctcataagattctaagtattgttgatatatattaatattaagggtctatctggataaatgtatttagaagtactactaaaaaaatccatctcaaagcagaaaacgcccttattagcttcacagcaaagacagaaatccacgtcaaaaacattaacaacgtgttttcaattgcctccccagggtcgaagcacgttttctcaacaaccctaagcaatgtctcctctgatctcttgccatctgagcttgcatgtcgatggcaaatagtttcccgagctcgtcgaaaaaccggtccagtttgtccttgtaacaagccctagtcacaaagtgtagccaccggatttttgaacactcgaaaacaagctgtgtcccctcctccatctttctgataaacgattggagttcctccttcggaagctgcaactcgttgtttttctgttctatctccttgatcaccggagatatagctactagagtggatattggaggtgcaccaaagatgatttgaagcaaaccgttttgtttttaagttccaaaacggttcccagcaactcgttgaacacagctcccactgttgcttctattagtagtgccatgatattcacaacagaaacacgcacccacaaggatgaaaacaagatgaagaaataaacctctctttataatatatagagtcaggttaaacgtaatgttaaaaaggaagtttcttggaactccatttctatcctgttgactttacgaacttgtagctaggtatacttgtttgtattatttaccgacttgaacatattttaattatttatttaattaactgaatagttataatttccttaatagatgcgagatgccaaatcttgttccaccctccaaccccaaggataattaatagttaagtgtgaaatagtatgtgtgtgtctatctatatatatattataaaattttttatacaattatctaattataacatattatttatgtgagaaatttattaattttttaaataattcaaatgataatttataatcagatgaccgtgtcaaattattttataccatcaatgaataaacattaatctctctctctctctctctctctctatatatatatataaattctaatcaaggttggttgaaattatcttacactaaaactaccattattcttattcaagagtatttcatgatgaaggttggattttaggagaaaaattcctaaaaattcctttttttttttgtgcaagtaaaatctaagaattcaaattgaattttatcattggagcaaaaaatgatagaagttgttgcattctatatagcatcatatgacccataaaaaataatccaagaatccaaaaaggattctttaaccaaagatgctctaagaatctcaatattttctcacttaagaaacataactatcaaattaatatactatgaaacgagtttaatctttagtgatttacttgagacaaactatatgcactactggcataatagactttaattctaaagaacaatacaaagacaacaaacatgttccggaaaaaagcttcctcaaaatggaggctacttcaatttagaacactcacgtgaagtgtattgtataacatgtctccttaggtcagaatgagagctttttattcgtgcttgaagcacgcccccttcaatttttacaagtcgaggtctttatgttgtatcaaaatgttcaatcatatccagctaatgttgtcgtgcaattaactttatgatagttgtcccttcatgatgactaactgtcgtaccataaacaattcattaatcccttacttttgctagcgagaaaattgttgctgcagtccactgtaatatcatttgttgcaaaaaattttgcaacgatatttaatgtcactaccactcttaacgctttcgcaacaaaaacttctactatttgataactacgaaaattaggcttaattgatagtcaaatttaactaaaaatgattagaatttctttattttattattatttttaatagaataatgaggattttaatatcattttaattcttctttcaagtttttaatttctcctcctcagtaatctagattccataagatacttcttgaagtgcagctatgatttttttttttttgtattttaccattcttttcttaaaattatcatacataattatatatgctatatacttgttgttagggaagaagataaaagttggttttcgaggatcagggcctccactgagaaaaggataagggaaggaacagttgtatattccattgattgatgctgttattacataatattatttatactgatttctcaataatcaaatttgtctttttgtgctacagaatatcagcaaatggttaagtttgtctacccctacagtacagtggcggattcaagatcctaagtcagttggtacaaattataaaaaataaaatcagtgggttcaattatataaatatagatgaaataaaatataaaaatataagattttatttacaaatttggtgaattttaaaaaatgaggggatgcaagtgcacaccctcagatggctgtaggtccgtcattgcttccagatatggtgcacctgcttgcaatccttgagctaagtgggccttgtaattgctctcttggtcttgttttctaattgcacccttttctgttgcttgcttgctgcattctcatcctctgtttctgcaactggttcctttgctacgctatcacttgtggtgccgtttttggcttttccagtcttcccaagttcccactgattcaaattccaaaagttctgcaaataaaattgaagaagaagctagaggtgggaaatacttaagtcattctcttgaaaaagttgcagcaatgatatgcaacaaaatatcactataccgagtcaaggtaattattgtgttcacatgaacatttctcccatgaaaatatatattttctgactttgtaatctctttatagtatgcatggaaaaataattttctgattttttttctctgtagtgttatatattatttttaatcacattttcttatttatttagtttgtttctgatttgacatcatgtgaatttggagatttgggttagaaatatttttggaattttcctggttagaacttgataggtccataatgaaggtatataaaaggatagggaaaagagggagagcggaatagaaaaagaaaggacaaatgggcctcaaaaacaagacatgcttgtgtatgacagcagaaagaatcagcagtacaagttgcactagctgaagtggaaaaggaacataggttgacataatggaatggatagcttgtaaggagagtgtacgtagaggctgagaataagttcttccttaagaaagggagtgggtctgggtttgttttttcctaattaccattctcaacatctggcttgtatccgccactccccttctctctgagttctatttttcatacttggaagcctattttttttaatataaatataaaattatggggatatctacctgtcaaaacttaatataatatattagtatctattatttatttattttattgattttatttagtaaaaatcacccacttttctttccgcatacatctttgacatatatgtaaggacattgaaatctttaattcattaatatatgtttttaggaataaattaacatgtgttctttctttaattctatgcgtatgggttaaccaatattcaaactctagaccatttagttaaaaaatacaagtcattactatttgtgtcaatcattattggtacactgcacaagtttaaaatctagttagatttgtaaagaaatgttatgttacatttcaaatgacttctgactttctttagtagctaaaaaacttgtttaactatttgataaacaagttttttcaataatttttaacattttttaaaacgttacttaaattaatatttttaaaaatactagtttctaacattttatatttttttcttattttatctttaatatataaacttaaatcttgaattagttagatacaagactatatccaatcccacttaactaacctcaagaaattagatgtcttatataattattaaatttatttaatacacgtctttcattttgtaatgataaaagatttactgataataatgcattccttttatagtattaattattttatttctattatgacattattttcttactctaatttttaaatatttttacttcataataaatataagaaatgtaatatcaaatattatattaaaattaaaataattttaatacgaataaaacaattaatcatatttctaatttatgcgttatgtttttaagctgaaaaataaaattaactgtaaagatttgggtttagttaaatttattcgtaattgactttagaaggagtaaattgaaatacacttttaaattaatatttgagtttctctatcaaaaaaggctatttgagttttatatttttattccgacgtcaaattctttgatatgtatagactatatttgagatacttttcgctttgaatttctatcacgctctgagaaatcaaatatatatatatttctcttgatcttaactttaaagtttaaagtgatatgagatttttacacatactaaaacaattttttctcaaatatgcatccattgatatccttgtctttgggtttggatccaagagtttcgacagcaatctgcgtacatctggtgcaatccagttaggaaatttgaactctcccctgccaatagaacatacaagatcataactccttctgtttatcacttccggagcagcataggcaggggcaccacatgtagtgtggagtaatccatttatattcccattttcatccagtagaagattttctggtttcagatcacgatggcacacacctcggctatggcagtagtcaacagcgctgatcaattgctgaaattatctcctagcatcatcctgcttgagctttcctttggataccttattgaagagctcaccaccttttacatactccataacaaagtaaattttggttttgctggccattacctcgtaaagctcaaccacatgtggatgcctggttagcctcatcgctgaaatttcgcgcttaatctgatcaatcatcccaactttcagaatcttctccttgtcagtaatcttaatggccacactcatgccagttatgatgttcctagcatggtagacttttgcaaaggttgaacaaggatagctcagatggaggcacggactcatcaacctcggtgaaggaattcttaactgtcaagcacatctttcaccattccctgattttggtgatgacactagagaacaatgaagaatatggacttcttggaaagtttgaagaataattaaggaatgatgcagcacctggttagccttccaattacccagcagcagaatatacaatgaaagacacacctgaaagaaagatgaacaaatttaataagttgggatcattgtcagagaatataatctcctgaataaaattcttgaaacttctacaaacataaccagcataacaatttttataacttgtttctgatgtcatttttgaacaatcccaaaaccataaggcattaggtgagttttgatcatatttaaacaggactggattaaaaaacaaagtatttagcacatcaattacatttctctcaggtagtctagtcgtttttagagttcttataaataaacgattcatgaccaagaagaacaacacaagactaaacaagtatgacagaaatgtaagattgtcaaaaatcaagaataaatcgaaaccagagatggccacacattatgcagaagaaataaaatttaatcaaacaatcaatcagcagatggcagaaagcacactaatacaacaaaatacatcaataatgaacttgagattcataaaaaaggagcatgcaaacaagtgagacctgcattctgttttgaattacatagacaaatcaagtcattcacactcatctgcccaaattaatcgtctaaagttgggagagtttaatgacactcgagaagaaaatgaaaattcagtaaggtttcaaataagcaagtataaatataactgagttgccaccgttttcagatgaatgtggttccactttccattacaatcgttaccgtttggcagtctatctaccaattttcatgcttgggtcacatgcactaagttattgtcaatacatattggcaacaaattaaaattttccagatgaaaaaaaaaggaaaaaatttacaaatttgccgataagagaaaaaggcaaataaacacaaacacccctctcaccaagagagagcttaactcatgaaaataacaaccatccacctataccagaatttggttttaaaatatcataattttgtactgtttatttttaaacatgttattatttgtaaaaattgaccaaaggtgcacttagatcttctcatgctacacaaaaatcaagtttaataaacattaagaaatatttgttacatttaataagggagattttcataataaaaaaaattctgaatttcaataaaaatacatttgatgatctattttttgtagtataaaatctttgtataacattagaaattatgaaatgtaaagtcataaaaaggaatattgatatactctatattgtttctaagttttttactatccactttgtagtagtattgaataagtaaaattctatcaaaatctttcacacaaataaaatcaggtgaaatctcaatattatgattgggcaagatttccctcatgaatgatagaatctgaattttatttgattcttgcttgctggttgattttttcttaagaatttaacaaatatatcttttatatatatatatatatatatatatatatatatatatatatatatatatatatatatatatatatatgcatatatatacttatattagatacattaaatttcaaatttctgtaacaacctttgtgaattataaggaaagtctggtcaactaaataagctaatttacactcatgcatacaatcgcttcacttgaacttaactcaatcgtcatcatcattattatagtgagttaatagaaatgcaagattctcattactaaaaaaaaatagtcattactaaaaaaaatagtcattccataaaaaaatagctataagaggtcttgttaataaatattcttaaatactaagaaaacttaaaaatattaaataaaaatataatattagtatattaaaattgtttgaaatttaatttattattcaaacaatttgcttttttaaaaatcttaacaatttcacttgttacaatgtgacaaaacattcaaggaagaaaaaacaaagttaacttatatgtggggagtgagaaatacgacaacaaatgacgctataaaagtaatatattgttgataaatagaaaaaataagtcctctaataaaattggtaaaacaaaattaaaacttcattcaataatattttatcatctataataattatgataattactcttaaaatcatctctacgatgatctctgagggaatgaaaatataaaataaatttcc

SEQ ID NO: 177 - DNA, 907 bp, Glycine max
  misc_feature (14)..(14): n is a, c, g, or t
  misc_feature (21)..(21): n is a, c, g, or t
  misc_feature (23)..(23): n is a, c, g, or t
  misc_feature (35)..(35): n is a, c, g, or t
  misc_feature (46)..(46): n is a, c, g, or t
gaccgctgggatangatccgncnctcgtgtgaatncaaaatccgtncccggggatcaggcaaaagttccaaaaaatcacaggtctgcttttctcaaagaaatcggaggaaagcgagaaaagagaaaaatgatatgaataccgaagaactcactaacgattgttgctttttctcaaatagtgattatgtctttggcaactgttcttgcggccatgtcctccctttggagtctaattttgatcttcgaacgtttaagttttcgacatagggttgggtggagcttgttcgcacgatgaagcaaaatgggaaagcttttgtttcgattgtgggaacactggtaagcgaaatgaactggttttgaaaaggggaaaataatggcacttaattagggattggaagtggaaagaataaaacttgatagagaagcaccatatccactaaaaaaggggtctcgatgttgtaagaagtcggtgggtctttctacaagtccttgagctccttgaggatgcgctttgaagccatgggagggacgattcgcattcagatctggatatcatgtcttggttgtgcagccccgattaccgcagtccccgaaagatggatctgaaagggaaagagggacatagcgcgagcgagaggtctctgtggcctctccctgctggttatcgaaatacccattgatggacaacaaatgctttgactctccccgagggcgcttttttcctaaaaagcttttcctctccgaagaccgctttttcactacggtttccgcccaaccccccggggaatggccactccccaacatcccacgtttcccataattgcccctggccgttcccacctacaatgggccccctttgcggaaccggcctcgtttttcacaaacttaaaaaacggcctttaccctc

SEQ ID NO: 178 - DNA, 734 bp, Glycine max
tgacaatagcccaaacacaaacacacactaggaatgagttatcacattcatatataataaaatattagagcatgtaaaacatataatacttaaagctgaatttatataattaacatcacttcccaaaatcacacacattttgcacatccattcaagttcatccactccagaaaataacatcaaaccacaattgttaactcaatgaaagtcaaacacatgcattatgcaacaaatactctagacttaagcctacatgcaatgtggtaccatttttcagtgaaaaacctcgttgggcgcctaagagtacatgacaggacatgcctcacaatgggtaagttaggtcactttcactaagtgaaatcatagggagaccagtcaggatcacgttgttttgcgagaatgctccaaccatgtgggagcggcacaggcttaaaggagcactcaaatcggatgacccccaaggcctacactccgaagagttcgtcagggcctctccctcctgattcaggtctaacccaaaaaaaaatttgaacacatagactctacctatgaattatgcaatgcacacaactactcaattgtgtgtgtgtgtatatatatatatatatatatatatatatatatatatatatatatatatatatatatgtatgtatgtatatttttaaaatatattttaactcagtgcacctcaaggtattaaactcgtcgggttcccgcagtggatcctcaag

SEQ ID NO: 179 - DNA, 19057 bp, Glycine max
accacttaagtaaaaaagaatcacttgataagaaagaactacgtaggtctgattttctcatcccaaattgaggaatacgtaggagcaaagggaaacacccttgtcgaccacaaaaaaggaaaaaatataaaaagggtataaaggatataagaacataaaagggaataaaaaaatcaaagtcatgtttgcacattcgattaaaggctgccgtcccttgggacgggcgtgtggggtgctaataccttccccgtgcgtaaatacaactcccgaacctttcaaacttaaaaattcgtagatcgcgtcttttccggtttttccgacgttttcctcaaataaacgttggtggcgactccgcacgtattcctttcgtggaacacgcatcccgcgagtcacgcgtcgccctcccgccgaagggtaggttgcgacagttggcgactccactggggacctgttttagagagttaggccatttaatcttgtgcaatgttttatcatgactttctcctttgttggtttccctttatttgtcttatgttcttgtgtatataaactatttgttgcttttagtgtattttaaaatgtatgcatgaggtaaatatttattcatttgatgcacacaaacaccaacactatttgcacacactgtgagtgaaaaaaaaagggccctatacccgggttcgtgggaacataaggagtggaggtgaatctgtgatcatgctaggtctccgacttgcttgattacagtgaaccctcatctagagcttttctctttgaaaacctattgttgctagtagtccctactgctacgatatgttcttcaaaggggatgatacctctagaaaccatcaagagagatataactaccttggggattattgctaaaagcctagttagttctctcccttataggtcctttaaataggggcacgaagcaaacacgctgcgtgccatttttcacactgccatgcatgagtatcatatacccttttgcttatgttcagtaaatattgtcatactgtgtacgttcccgcattgtgtcttttgcataagcattgcatacggattctttcttgatccctactgtaaacaaaccaacggagggtccgtgtcgccttcttaaaaacgtgcgttggcggcattttgctacccctagacgtcgtatctaagaaggggacaaattccccggacccccgcattcctagattgcatctgtgtcatatgcactccatcatgcattcatccattccacccatgagatatcggagttttgatttgcaccagcttttatctcactttagtaagcatgggaacaaatcaaaccggcaagaggttttaccaagtcaaggtcaaaagcccagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcccttgagatgcttcacattcggggacttccaattagtaccaaccattgaagaatttgaggaaattctaggatgtcctctcgggggaaggaaaccatatcttccctccgggtgtctcccctctttgagcagaattgcaactgtggtcaaggattcagccagaggtttggaccgcataaaacagactcggaacggcatagcgggcctgccacagaagtacctagaagacaaggcgaggggtatggccaatcaaggagactgggtcccgtttatggatgtgttagctttgctaatttttggggtcaccctctttccaaacgtggatggtttgatagacctagcagcaatcgacgctttccttgcctaccaccatagcaaggaaagtccggtggtagccgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcatgtactgaaaagaggagaatagattgggaccagctcttggccgggataggaggtagaacaatcagttggttcccccgatggaaggaaggaaaagaaggagtcctttcctcgtgtggaagatacccaaacattccgctggtagggacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaagcatgggaaaccccgttaaggaaagatcaagagcttagaggcattcgtaatggcatcattggtgggtaccaccaatggctgaaagttcgcatacgaggtttagattggctcgccaagttaaaagtcgtcagcgaagagaattttgaagcaccggaagcggatgaagaagtccaagctctcaaaagcgagttaggaaaggcaaaactcgccaaggagaagttcaagttggctgctacacacgttcggaaggagtgtgccgggttacgggaagagaatgcaattaccgcaagggcccttgaacaagagaccaagagggctcgcagggaagagtatggccggaacaaatttcgcggagctctatggggtagcaataatgaactcaagttgcgaagggaagaaagggaccagtcgcgagcacatagcatggttctgaaagaggagttgattacttgttcaaggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcagtttgctcttaccttgaacgggagtcaagaacttccccgattgttagccaaggccaaggcgatggcagacacctactccgcccccgaagagattcatgggcttctcggctattgtcagcatatgatagacttaatggcccacataattaggaatcgttaaagaaacttgtatggtctctcagaccttgactagatatgatttctttttttataaaatgagttggtcccatgtttctactccaaaaagcttgtgcaaatcaaatcactcctacatctcatctctagcatgcattttctttctttacccactcctcacgtttggttttttagggaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactcccttggcaactacgcaccatcctccctcaaacatagtaggacggggaagggacacactgggacacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattacgctcgaagggatgtcgagttctatcccccgatccccgaagggccggcaccaggcacattgcctcaacccaacatcgcagcaccgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaagttcaaagtgccggacttcgacaagtataaagggacgacttgtcccaaaaaccacctcaagatgtactgccgtaagatgggcgcccattctaaagatgaaaagctgttgatacacttctttcaggatagcttggccggagctgcggtagtgtggtacactaatttggaagcttcccgtatccgtacttggaaggatctgattaccgccttcctaaggcagtatcagtacaattctgatatggctccagaccgtactcaactgcagaatatgttcaagaaagagggtgaaacctttaaagaatatgcgcagcgatggagggatttggcggcacaagtagctcctcccatggttgagagagagatgattaccatgatggtagacactctgccagtgttctactatgagaagctagtgggttacatgccgtccagctttgcggatctggtgtttgccggggaaagaatcgaggtgggattgaagagaggaaagtttgattacgtttcctccacaaacgtgaacgccaaaagaatcggggcaacaggggcaaaaaggaaggaaggagatgcccatgccgtctcttcaacgcccgcatgggtcaaaccccagcaaacacctcatggtacccatcagtacgcgcaacatcacccaagcttctcggctcctgctgggaacgcctctagctcaacacccgtacagcctaaggcacccacccagagggaagctccccaagttccaactccgaacgcgactcgaccagccggtaattccaacacgacaaggaacggccctccgaggccgttgccggaattcaccccgctcccaatgacgtacgaagatcttctaccatccctcatcgccaatcatttggccgtggtaactcccggaagggtcttcgaaccccctttcccgaggtggtatgaccctaatgcaacttgcaagtaccatgggggcgccccggggcattccatcgaaaaatgcttggcccttaaatacaaggtccaacatctaatggatgccggatggctgactttccaagaggatcggcccaatgtgaggaccaacccgctcgccaatcatggagggggggcagttaatgcagttgaatccgataggccccacaggtctaaaccgttgagagatgtggcaacccctaggaggtttatctttgaggccctacagaagggaggtgtaattccccatagtgggtgtaaggaggattcctgtctgctacatcccggcgagatgcatgacatggagacgtgtttggaagtagaggaattgttacaatggatgatagaccaaggtcgactagaagtcggcattaaaggaaaagaagagccgcatatatgcatgcaatctacggaggggagcggtattgcgaagcccaaacccttggtgatatactttactaaaagtgcagcctcgcaaaagcctgggcatcccttaatggtcaaacctgttcctttcccgtaccagaatagtcacgcggtcccgtggagatatacacctccggagaagaaggaagaagaggtcacagacatcagctcgctgtcggctaaagtaacaaatatcacgggactgagtggtgtgacccgtagtggtcgtgtgttcgcacctccggacctaccggtccaacccgccgacgtcaagggaaaaggaaaggtggtggaggaacaagatggcgaagcaccccacgcttcgaataaagatattccagcaaaggggcccccagagaaaagggatggtagaaaggaggtgtcgctagaggaagccagcgagttccttcggataattcagcagagcgaattcaaggttatcgaacagctcaacaaaaccccggctagggtctcgctgctagagttacttatgagctccgagcctcatcgggctctgctagtaaaagtgctgaacgaggctcacgtggcccaagatatttcggtagaaggtttcggagggctggtcaacaatatcactgccaacaactatcttgccttcgccgaagaagaaatccccgccgaggggagagggcataataaggctttacacgtatcagtcaagtgtatggaccatatcgtggccaaggtacttatcgataatggttccagtttaaacgtgatgcctaagagcactttggacaagttaccattcaatgcttcccatttaaaaccaagttcaatggtggttcgggccttcgacggcactcgccgagaggttaggggagagatcgatctcccagtacaaataggccctcacacctgtcaagtcaccttccaaataatggacattaacccaccctacagttgcctgttggggcgcccgtggatccattcagtgggtgttgtgccttctacactccaccaaaagctgaaattcgtagtggaggggcacttggtcatcgtgtcaggcgaggaagatatcttggtaagctgcccatcctccatgccttatgtggaagccgcagaagaatcgttagaaaccgctttccagtcttttgaggtggtcagcatttcctccgtggactccctctttgggcaaccttgtctgtccgatgcggcggtaatgatggcccgagttatgttggggaacggttatgaacccgggatgggtttaggcaaagacaatggcggcataactagcctgataaaaacccaaggaaatcgtgggaagtatggtttaggctataagcccactcaggcagacgtgaaaagaagcatcgcgggaaggaagaacagtggtcagagctcgcgttggagacaagaaagtgaaggaagcccgccctgccacataagtagaagttttataaatgcgggtctgggagacgaaggtcaagtggtcgcgatatgtgaagatgatgttccaagaactctggatttggtccgaccatgccctcctgatttccagctgggaaattggcgggtggaggaacgccccggcatttacacaacaagcataatgtaaacctttacgtttttaaaagctctatagttgggcctaggctttagagttttcattttgttaaggctttgtgtcttttgtctttgaatttataatacaaagatctttcttcatctgttcctggtctctacccattctcattcatttgcatgtttacttctttttctgaaacggcagatccgatgacgagtcccccgaaggtactaatacctgggacccgtctatcaatttcgagcaagaaatgaaccaaacggaagatgaaggagatgagggggtgggacttccttcggaactagaaaggatggttgcccatgaggaccaagaaatggggcctcatcaagaagaaacagagctagtagacttgggaattggcagtggaaagagggaagtaaagataggtgcaggcattaccgcacctatccgtgaagaattaataaccctgctaaaagactaccaagacatctttgcttggtcataccaagatatgcccggtttgagttctgacattgtgcagcaccgattgcctctgaatcccgggtgttccccagtaaaacagaaattgaggaggatgaaacccaaaacgtccttgaagataaaagaagaagtgaagaagcagtttgacgctggatttctggccgtcgctcggtatccagaatgggttgccaacatcgtaccagttcctaaaaagggtgggaaagtacgaatgtgtgtagattaccgggacctgaatcgggccagtcccaaggacaattttccgctaccacacatcgatatcctcgtagataacacggccaattttgctttattttccttcatggatggtttctctggttacaatcagataaagatggcacccgaggatatggaaaagactactttcgtcaccctgtggggaacgttctgttacaaggtgatgtcctttggactcaagaatgccggggcaacttatcagcgggccatggtagctttgttccatgatatgatgcatcaagagatcgaggtctacgtggacgacataattgctaaatctaaatctgaggaagaacaccttgtcaacctgcggaagttgtttgaaaggcttaagaaatatcaattaaggttgaaccccgctaagtgcacctttggggtcaaatcagggaaattgcttggtttcgttgtaagccagaaagggatagaggtagaccccgaaaaagtgaaggctatccttgagatgccggaaccccgtacagagaggcaagtccgaggtttcctggggcgcttgaattatattgccagattcatatcgcagctcacagccatttgtgagccgttgtttaaactcttgcgcaaaaaccaaactgatcggtggaatgaggattgccaagaggcttttggaaagatcaaaaagtgcctaatgaatcctcctgtgcttatgccaccagtacctggaaggcctctcattttgtacatgacaatcttggacgagtcaatggggtgtatgctggggcagcatgacgaatccgggaagaaagagcgcgctgtttactacctaagtaagaagttcacgacctgtgagatgaattactccttgctcgaaagaacgtgttgtgctttagtatgggcgtcccatcgcctaaggcagtacatgctgagccatactacctggttgatatccaaaatggacccggttaagtacatctttgaaaagccagctctcacaggacgaatcgcccagtggcaagtcctgctatctgagtttgatatagtctacgtcacccaaaaggcgataaaaggaagcgctttggcagattatttggctcaacagcctcttaacgactaccagcccatgcatccggaattcccggatgaggacatcatggccttgttcgaggaaaagttggacgaagatcgggacaaatggactgtatggtttgacggagcgtcaaacattctaggtcatggcgttggggcagtgttgatctctccggacaatcaatgtgtacctttcacagccaggctaggattcgactgcaccaacaacatggccgaatatgaagcatgtgccctagccgtccaggcagcaattgactccaatgccaaactactcaaggtgtacggcgactcagcgttggtaatccatcagctgagaggggaatgggaaactagagatcccaagctgataccctacaaagcctacatcaaggaattggctaagactttcgatgagatctccttccatcatgttccccgcgaggaaaatcaaatggcggatgcacttgctacattggcatctatgttccagctaacaccgcacggggacctaccctacattgaatttcagtgtcgtggcaaacccgcacattgttgccaagtggaagaggaacgggacggaaagccctggtattacgacatcaagcgatatgtcgaaagcaaagaatacccgccggagattgccgacaacgataaaaggacattgaggaggttggcagtcagtttcttcatgagcggaggcacactgtataagagaaatcacgacatgacactcctgcgatgtgtggatgccaaggaggcaaatcacatgatcgaggaagtccatgagggctcgtttggaacacacgccaacgggcatgctatggccaggaagatcttaagagcaggttattactggcttaccatggaaagtgattgttgtgtccatgtgaggaagtgccacaaatgtcaagcgttcgcagataatgtcaatgccccaccacatcctctgaatgtcatgtccgccccttggcctttctccatgtggggaatagatgtcatcggggccattgagcccaaggcctcgaatggtcatcgcttcatcctcgtagcgatagattatttcaccaagtgggtcgaggcggcttcatataccaatgtcacgaggaatgtggtggtcaggttcattaagaaagagatcatctgccgatatggtttgccaaggaagattatcacggacaatggcaccaacctgaataataagatgatggcagaaatgtgcgaggagtttaaaatccagcatcacaattccacgccctaccggccaaagatgaatggagccgtggaagcagccaataagaatatcaaaaagattatccaaaagatgaccgtgtcatacaaggattggcacgagatgctcccattcgcgttacacggttaccggacttcagtgcgaacgtcaactggggcaacgccattctcattggtatatgggatggaggcggtgttaccgtttgaggtagaagtcccgtcattaaggattttggcagaatccgggttaaaggaatcagagtgggctcaaacacgctacgatcagctcaacctcattgagggtaagcgcttaacggccatgagtcatgggcgcttataccagcaaagaatgaagagtgcattcgacaagaaagtacgcttacgcaagttccatgagggagaccttgtgctaaagaaaatgtcccatgctgtcaaggaccatcgagggaaatgggccccgaactacgaagggccttttgtcgtgaagagggctttttccggaggagctctggtgcttaccaacatggatggcgaagagctaccttcacccgtgaactctgatgtcgtcaaacaatattatgcttagaagctggggcaattaaggatgtcgctgcatgttctgtatctttatgcgttttctggatttcccccagggatttcctgtctgttgtatctctcgttacaatctttcaaagaaatgaacgtggattcgaggcttttagtcctcacgttagtttcacatcttgcgttaatttgtgatcacctgagcccttccgctcagttcatgggatcccccaagcgcttaattagaattgaacctgaaccaactttccctaaattttctgcgtttgaaaacattcatgcatacgcatacgcatacgcatgtatattgttgtggtaaaacaggggcaggatcaccttgggctactttctggagtgaggacaaaacaggaatggcagaaaccagtcaaggtagggtaatgatgcggccaaaattggccatacctggttgtttattacttgcaggtacttaaggatgaacgcaagcggggatggggtcacgaccgaccgatcgttgcccttctctgtgcgaaacaagcagggaatgtcgctgcaaggcagccccgtatcctttctattttgtagctttcttttactatttgtttgttttaaaaaaaggaaaagagtaataataagataagtaatcaacgcctgattctaacctaagtaagttcaagttaggcaaaaggctaatccatgagaagggaggggacatggtcaatgttcccctcaaaaaaaaaaaaaaaaaaaaaaaaagtgcaggttagctcgcctgggcgagctgggctcgcctgggcgagccacctctgcaccaaaatataaaaatgacgaagggggggatgttttttttcattcaaaaacttccccccctcattcaaaaaaagaaagctcacgggactcacggattttgcagcccttaggtcaccattttttgcgtttttgattccgttttgctctattattcgtctccaacaagtaagtacctcattcttgggctttctagctttccattgatgtattttggtgctctaaattgcatgtgtttgctaagaaacgtgagggatttatcctcaaattgttgcttgtttttgttgaattgaggggttgtaagggatggccttggcctagggtgtattctgaagtaatggcgcatgccacattgtccccattctcttgatattcgtgcctaaacatgcgcccaccaagtgctcggtgaaatgcctcaacgacatatgagcatggttttgtgagctttgggttgtgggactgttttatatgtatagggacagcatgaaggatttaaaatgaatgcccgaatgcaattctaggcctaggaacccaagcttttaatttcaatacaaggaagcatgacttacgcctaggaatctaagttttggttttgaatgtaaaaaggcatgaatattaggacatgtttgagaggttgttattagaatttaaatttggctgccccatgaggaataccttgcacctaggtagcatggaaaatacctttcaacggtatgtatatatgtgaatatatatagcatggaaatgccttgcaaaatatgaatatatatagtatgaaaatgccttgcataatatgaatatatatagtatgaaaatgccttgcataatatgaatatatatagcatgaagtgccttgcaaagtgttggatgggtagcgtaaaagtgtttttcaaaatatatgtatttgtgagtaggtaataaaagaaaccttccaaaaaatgtatatatatataggatgtagcatgaaaaggtttgtcaaaaaatatgtacatggataggtgtcgcaaaatgcttcacacaaaattttttatgtgtgcaaatacgtatgtgtcataaaatagcacgaccccaatatgattattttataaagtgcatgttgacactcgggccatgagaagtgttgtttggcccttgtttgtaatgattgttatatttcttgtaaactaactttccaaatgtttgccttcgcaggaatggccccgaggaagcttgcctcaaagaggtccaggaaggacaaggcggccgaaggaactagttccgccccggagtacgacagtcaccgctttaggagcgttgtacaccagcagcgctttgaagccatcaagggatggtcgtttctccgggagcgacgcgtccagctcagggacgacgagtatactgattttcaggaggaaatagggcgccggcggtgggcaccactggttactcctatggccaagtttgatccagaaatagtccttgaattttatgccaatgcttggccaacagaggagggcgtgcgtgacatgaggtcctgggttaggggtcaatggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaggattttgcccggaccgctgcagggaggcgagtgcgagtcatgcgcaccaacatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcaggtatggcgcccactaggcaccctttggacccagataagtccaacagggctctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgtgccaccaccacctcatcaggctggccaggctggggcatttgacatagagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaagttgcatggcccggagattggcccgaggcccaagcaggagaggcacccccagaagctcccggcgatggagaagaagcccacgaggatgaggaaatggctgatttgcttgacttcttgggagggagtggagacacgtgactgggagatccccagattcatgttttctttcatatttcttttgtcatttttttgttctatgttattgttttgacttgagagactaacgtttgtttttgttgtttcgattgtcattttgtacagtgcatacatttttgtttagattggtgcgttagtatttatatatcattactatcgatgatgtttgaaattctggaaccgtgtagagttcttcgtttaggaacatcgtccaaagtatatatgtaaaataaacaaaaaaatcatgataaaagtaaaaaatagagaaggaaagaaaatgaaatagaaaaggaaagaaaatgaaatagaaaagaaaagaaagtgataaggaaaaagagaaggcaagagaaaataagttgtctagctaaaaaaccaacatgcttttgaaaagagacgatttccaacttttctttgaaaaaagttcattgatcataaccaattcttggaaaatgtgtctacacctgaagggtgaatgctgtgaaatttccccggatgcccgaaatggactcggatgaatgcacaaattgataaaagaacatattttggaaacattgggtcgattaaaatagagggaatgaatcctgagccctagcatcacatgaccataaaagtttgacacttgagtgtccgcgtagatgcatgcatgaccagttttgcataaagtttccaaatcatcattttcgcatttgtgtcatggaaataatgtggggcatcccttttatccttgaaccaaaccaaaccctgacatgtatcatgtctagccattctacaaaccttgattcaaaatcatgactcactataatccttaccctcggaagcaaaaaaaggaaagaaggaaattttccaatcaaagagaaagcaaaaagaaaagaaaggaaattcccaatcaaagagcgggagaaagcaaaaagaaaagaaaggaaattcccaatcaaagagtgggggaaagcaaaaagaaaagaaagaaaattcccaaccaaagaatgggagaaagtaaaaaggaaggaaagaaagttcttgatcaaagaaactagaagaaatgtgcagaaaggtcttttgaccagacaatatctgaacaatacagaattgtcaccaaatgaacaaaaaagaaggaaaggaaaccacgacctaaaatggtcttctccctttgtttaccaaccaaaatcccgtgcgctagcgaccttttttctcgccccgcactaaacaaaaaaaaacagacagaaaaaggaaaagctagaaaaatcaaaagccaaaaacacacaaaagccgaaagaagaaaccaccaaaagaacccattcccaagggaagccctattgatccatgatcacgcgtgtaatttttgatttgataggaaataatttgtaaagtcaagtcatgacatatctatggttcggaattaggatgaaacacttacctgtgcgagattgatacactttgagtagatttcttctatttttgtcgaacccagtgtttcctctaaatggtcatttagaaacgaaatgctaacatccaagatctcatttatggttatggggggatcccatcagcagactctccttccctggtaggcgcattgtttgtcactcaaaaaaaaagcatatgctgctctaaatcagttggaatatttgtctctttgctaaagcatgtttgcattttagtggagaaaacaacgaaactttttcaagcctcacaagttatccagaactacgtaggtctgagttcctcattggaggatacgtaggagcaagagcctcgcttttgtcgaccacaccgccttttgttgccataactcaagagctggtagtacgcggagataccttacgcttatccgcaccccttttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcaccccttttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgtccgttggcaagcagagaccaagtttggtcattctgcacacatgatacgcggagataccttacggttatccgccccccttttgccattcagacacagtcgtgtccgttggcgagcagagaccaagtttgttcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgtccattggcaagcagagaccaagtttggtcattctgcacacatgatacgcggagataccttacggttatccgccccccttttgccattcagacacagtcgtgtccgttggcgagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatcccccccccctttgccattcagacacagtcgtgttcgatggcaagcagagaccaagtttggtcattctgcacccatgatacgcggagataccttatggttattcgcacccattcttttgctatctgtaagacagaacgcttgatagcatgcaggggctgacacagtcttctgcaccttttgttcctctgggaacaacaagtcatttgcatgtggagattttatggtcacccgcgactctcgtcgaaacgagaaggacgaaattagtgtcttatctttacttttcttttatctccaataaaagacaagtaaagaggggcaactgtcataccctaatttcgtccgggaacctttgctcgatgacatgcgaccattctttggtccttgtgaggtgcttggcacccatcattaggcaatttatgaaattccaggacatgccgaaaaaccaaaaaaaatattgatgcacaatccgtaagtttccgtgacacaccggaaatcaaaaggaagcatcgttgcataattaagtgaggttccgtaacattccgtaagtcaaaaaggggatgattatgtaattcgcaaggttccgtaacattacggaaagaaaataagtatcgttacgaaattcgtaagtttccgtaactttacgaaaaaagaatcaccaaaaaaacagcagagggggtgtatttagtaaaaatgggggtgcaaatagcacccaggcccacttgggccctccagaagattcctccagaaggcggttgcttctggaggaagcaaccctgctcgcctgggcgagctgagctcgcctgggcgagctgggcggcaagcatctcccctattttgctataaataggggagaaaatgaagaagaaaaggatcccagccctttaggcacttctctctctttggaatttgcttggaaaaattgtttccgtgaagaaaatctaagccgaggcgcttccgaaacgtttccgtaacgttttccgtgaggaatctcgcaaaggtttgaaccgttcttcgacgttcttcattcgttcttcatcgttctttgatcttcaacgggtaagtacctcgaaccaagcttttcgattcattctatgcacccgtagtggtccacattgtgtttcgtgcattttgattctcattttgtttactctttataccccctgttgacgtgcttaagccattttacttaagtcgtttctcgcttaacttaaaaataaaataaatttccaccgaacgtttgaattgtattatccattagcttcggttaaaataaattccgaccgttcggtcatgccgtaaccacgttggaaatcaaaaagaggtaaaaaataatataataatcaaaaagacatcttttagtaaaataaagcggaaaatcaatcggacgttttctctttgggatttctcattcttaaccgaattgattaataactaaagtgaaactaaggctaacatcaactcgcctagtcaagctcgtccacaaaaataagcttttgaagtttgtcatttcaatttctcactaagtaaaat

SEQ ID NO: 180 - DNA, 34908 bp, Glycine max
  misc_feature (34905)..(34905): n is a, c, g, or t
tcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagataatggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacaaagagaatgggatcaaagaattgggaggactttcaaatcttcgtggtcgacttaaaattaggaacttggagaatgtttcccaaagtgatgaagcgtcggaggcaaggatgatggataaaaaacacattaatagtttatggttggaatggtctagatgtaataacaacagtaccaacttccaactagaaatagatgtgctttgcaagttacagcctcactttaacattgaatcgttgagaataaaaggctataaaggaaccagatttccagattggatgggaaattcttcctactgcaatatgatgagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatctcggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttagccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttgtccgattaagaggagtttatagagtagattaaattggttttgaaaaagagaaatatcatcttatacaatttttggttttcttaattcattgttcaattgatgtagtttaaaatttaaatatgatttaataagtttggattgatctcgatcttaagttttaattttaattctattttttcaaaaaaaaaatattaaagatatataataactgtgatacaaagtaatttaaaatattttaccaaaaaatgtaatttaaaatatcacatatatataaatcattttaaagctaatagtaatattttctaaaaagaagctaaaagtatatctctgttatacaagttgataattatatttatatatacttgaatagttactgaatattatatttaattaaatttacttttcataaataatttttaagtaatgtaataatttttatatatatatatatatatatatatatatatatataataaataaaaatataaacatcaatgatatcataaaattttggtaataataatttttaaaaaaaaattgtgaattaactaacctttcaggttctagagtaatttattaatccaaattgccttgaagcatattcccatgcaagtcaagttgagggacttgatggaggccatttctgaaatagagttaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggcaaggatgaggagactttatttcatgtaaaaaatattttcctaggagtatatatatgatatatgattatgttgggtcatatttatggtatctcaaggtttcaattgacagttttggctatctcggaaattttccttgtaccaaaatattaacaattgaaacatgtttcaaatccagttacttttggtaccatagaattgaaattaatttatttcaaatacattgtattcttaatatattaaatatgttaatttgttattttttttaaaaaataatcattagaaacaagttccggtataggaggcatacttagtgtttaggctaaggaataatgccaccgggttcaggaacaagcctgttgaggtgtcccttaacgttccgtgacatccccactcttgcatggacattctgtgcagagaaacgatgggtggatggaggtaagattgggtgagttctataatagtcactgatgagaaccccaagagcagcattgaagttcgaggaatccaaataagaccagcgtaaattatcaatttcatctcttaaatagtcactaaaataaaatataaattaattctttcaagtattgaaacattcttcaaattaatccttatacattgataaaatatttcaatgtatatatgcattaatggatatttaacactttagaaattacttatatatgattttgttattttaaggactatttataagaaagagtaatactctagatatcaaattggtagttaatttaattactcttgaaataagcatgctcaatttataatatgttgttttgttggcaattaaataagcacaccctctctagaatggtgtgtatgtacttttctgtatatgttgttttgtttgtatacttttgcttgcatagatcccaaaacaattgggtgattttcattcttctataaattttcttataaatatttaagaaatttttgctaacacaagactggtgatatgatgttaagattgacataacaaggacgtgagagttcaatttttcacatgccatgtcacccatcatagtaccttgttggcatgtattaagtcaacaacaaacttccattttaaccatatctttgatcaccgcaaaaaattattaaatttactattaaattgtttatatttatttttctttattgttgggctgagatttttttagttactaaaattataaaagtttttttaatctctgaattttgataaattgttctttttagtttctgatttaataaattaatattttataataattttaaaatgaaaaattcaatggctaaaaaataaaaatcaattaatggttgctaaaacctaaaggatgttgctaatcagtgccctaaggcattagttaataaattaaaataaaaaaatatttattatgaaaatcataagagtatgtaaaaaaaatcataaataatactattttatatatttcaataaaaaaattattattttagttctttataaccaattaataccttaaaaacactagttaacatttaccataattaaattaactaattttgaaataaacttcaattattcaattatgtcttaataagcttgatttttcccttactactgcaagtttgcatcctttattaaagtgaagtgatgaaatgttgtctgccatttacgaatatcactgaaattaaagttgttttctagttgaatttataataagtttttttaattgataaattttaatcgttattttgtgagtttttgttagtataaggaagtaaagtcacaaattttcttttctttcataattttttaaccatcccatcaatattatatctccatttacaataagttaataactagcaagatacccatacatttacgcagatcgctctccttttttacgcatattcaaaatacacttgcttaaaaaagataattagctatttagtatttatattcaataaacatgaaaaaaggattagaatattcaagcaaaaaaaaaatcaaaatcctaatttttaggctatttaaatcattgtcttctattatttgaaaattgaaactattattcatatttttacctgttttatcttcataaattctattttaatatatttattatgtatttatgtaaaaaaatcaacactattaaaattaatttaatttgtgatattattcagtatttaatattttgttataaaaatatatttaataaattaatattaaaatatttcttatataattatgaaaaaatgatatttaaacttattttataaatattagttaataaaatttccatatatgaagttattaaaaaaagagacaaaataatattttgtaataaacatattacctaattagatttaaattaattaatagtataaaaatttcaactacataacataaattattcaaaaaatatttcattcataaaattattttatacggtttctaagtaaaattgattttataggatttcaaatttttaaaaagatatcgtggattctttaatatgttgttatgttaaatattcttaaagaaaaagctttgtcacccataataattggcctgtaatgacgttaaacacgtgattgtttttcatgaatgatatttttggtctctatcataaaaaatatatattaattaaatgtattattgagtaagtattttaaaagtattgtattaaaaattatatttaataattaaattttagtagttattatatattatgtagaagtgattataaagtaaaaatgggttttcaaattaaaaaaaaaatattatttttactctttgatatacaattgtgttaactactaggcgaaagaactgtgtcatttgtaataattttgagtaggattatttctcatcaatgattattaagatccctgtcatgattaaaatgattttaatttatgatattattaagtttttgatatgaatttgtgtgaaatacttgaagaaagagcatattcagtaagtaacctaaaactattttgtaataaaaatacattttataaattgattttaatatttttattactacatattatgtaaaaattaaaattaatataatttatgattttattgagtaagtaatttaaaattatattgtgataaaaatatatttaataaaatgttatataattatgtaagaatgatttccaaataaaaataatattataagatttgaaagtaaaaaaaaaaatactatttcagttttttttatgtgtagttgtgttaactacttggataaaaaaaatattgtggtctataatagtctttggcaagattttcttgtcactaatcatatttgtaatctctagcataactaaaattattataatatatgatattattaagtcttttggtatgtagttttataaaatattggaagaaatagttttgttgcatataataatccaatttcgagtaggattttttcttatgaatgatatttatgatttctactacaaaaatatttaaactaattaagtttatgagattattgacgaaatgatttaaaattagttttaataaaaatatatttaattaattaatttttaacatagagtcaaaacattattttgtaataaatttgttaactaattaaaattaaatttatttatagtataaaaatttcaaccttataatataaatattaatgaataaaatatttatttataagattatttaattttattttatatgatttctaattaaaactaattttataaaatttcgaattaaaaataaattgttgagtctttaatatgcaattgttttaattactcgcgaaagagttttttttttcctataatggttggcccataagaagaattatttttagtcattatcccaaagagaataaaactaatttaatttatgctatttcttagtaaataatttaattttttttaaaataaaaatactaagtgactaatcttcctcaagaattctgagtgcacataatttgactattcccctcccaacccaatttatttcatacacaaggatcaacggggactaatatattaattttaatatatctattatatatttacttaaaatgattttatagaatttaaaaataaaaataattattattgaatttttggtttgcatttgtgttaactactcagggtaggaacattgacgtccataatgacattgagtaagattgtatcccatcaatgatatttgtgatctctatcatatttaaaattatttaaatttatgatattgttaaatctttaatatgtacttttatgtgtgtttcgttgcatttgcacataagatctctagtaggattattttacttgaatcatccaaggttgttaaactcatgttttaaatcgtagaattgtatgattttacgattccactaagcttcagcgagttaaatcgaaagcagaattgaaaacggaatagactcatctgatttagcgcaaacttgggcgagtttgggtagactcgcgagtctgctacgagtatgtggatttacgaaaacccgaaacggtgtcgtgttgtagctacttatttgagtagactttgtctaccttgttcgagttatgcaaagtgcaaaattgtttggttcatgcttcttggcttcttgctgtgatgcagtcggtgctagagtgctacggtggggtgcgacggtgaaaggaggttttcggtgttggagtgcgactgtgcaagtgtgtgacacagtgcttctggatcttttgttggaaggaggttttcagtgaaaggaggttttcgatatatgggatcaaggtgatttgttgcgaacaaaagctaaacttcaaattgcacagggccagttaaggaacaaaagctatactgatatacgcagttgctagttgttcttcaaattcagagtaaaggttttaatttggttctgggaagaagctatacaaggtttgttgttgtaataacttatgctgattgaatatttctgaaccatgggcctttattcctgttatttactgttagaattggatgaatgcagtctcatgaaccttttgaatttattagatttttcaagaaatttgtgatcatgggtttgttagaaaaaaggaagtgtcctgatagtttgtaccttagaaagtgagaatattgatatataggaaagtaatagtgagagtattgaagatttgatcaccattttatttggtttgaaatggaggcatttcgtgaaaaagtagagtgcagaatgcatagagttcctcagaatttcgcatgtgttgatgaagctttttgaagcatggtacacctttaagggcatactactgttgggttcatatattttttggtttaatgagagaattgaagatttgatcaccattttatttggtttgaaatggaggcatttcgtgaaaaagtagagtgcagaatgcatagagttcctcagaatttctaacatactactgttgggtacaccttgaagcatattcccatgcaagtcaagttgagggacttgatggaggccatctctgaaatagagtcaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggaattgttggacaaggagggtttcactactgacaaactgctaactcagttggagaatgttgtgtaagtgttaatgcaaaggacaataccgaaatgcatgaaaagatcatcatctcataacagactctttcacatacgaccgaccacctcaactgcaatggcatattttggtgaacgaaattgttctgactcacgtagattcaaagtgaatattcataaatcaggcattttctttgctttgtgacaatgtcactaaaccttcaattagttgatcttgttctagctctatagggtaataaaagtatatcaatgtctgcaaaatacatcaataagatcaagacaccaaaatatatatatgtgcttgaattatttataaacttttattttgattccgggttacaacttatcttaaaatattttcttttttctctgtttcttctttcaagtttttaatttaacttcctgggtaatctagattccataaaatacttctggaaatgcagatatgatcttgttttttttttttgtattttactattctatatattttatattagtgttgtttattttcttaaaattatcatacataattatatatgctatatacttgttgatagggaagaagatagaagctggttttcaaggaccagggcctccacggagagaagaatgagaagaataagggaaggaacaattgtatattccattgattgatgttgttattacatagtattatttatactgatttctcaataatcgaatttgtctttttgtgctacagaatatcaggaaattgttaagtttgtctattcctacccgaccagcatcattcttccagatatgatgcacctgcttgtttcacacctaatccttgaggtaagtgggtcttgtaattgctctcttggtcttgttttctaattgcacccccttgcttctgttgcttgcttgctgcaagttcccactgattcaaattccaacagttctgcaaataaaattgaagaagaagctagaggtgggaaatactcaagtcattctcttgaaaaagttgctgcaatgatatgcaacaaaatatcactatacggagtcaaggtaattattgtgttcacatgaacatttcttccatgaaaatatatatttttttactttgtaatctctttatagtatgcatggaaaattaattttctgatttttttctctgtagtgttatatattatttttaatcacattttcttatttattagtttgtttcttatttgacatcatgtaaatttggagatttgggttagaaatgtttttggaattttcctggttagaacttgataggtccataatgaaggtatataaaaggatagggaaaagagggggtggggaatagaaaaagaaaggacaaatgggcctcagaaacaagacatgcttgtgtatgacagcagaaagaatcagccgtacaagttgcactagctgaagtggaaaaggaacataggttggcataatggaatggatagcatttgatctttaataaatttttgctttgtaataggttcctaatatttaaaaagttttgtttgaaatacttatcattagtcaaaatctgttatttgctcacacgatcgttaaccagccacacagacatgtcatgtgtgatttttgtctgactgagattaggattaatgataagaaactatagtcaaaatcccttgggcataaaagaatcattcttcagcaaataacggattttgactaatgataagaaactatagtcaaaatcccttgggcatcaaaaaatcattcttcagcattcctctacgttttcacacaacccattatagtttcttctatacctttcttatggatttgtcactatgacttcgtcactcgtgaagatccaaggtgaagaggtcctcaccaacgatttttaggatcttgcaatcaattttacattttcaaatcaaaccaagccaactcccaactcaagaaattcacatggataaggtttctaagagaacacatcaaaatagtttcatgggtagaagaaggtcaacaaaaccttaccctaaaatgcgattccgctcggtccattgcatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcggccaccactggtgttgccagtcgtgccactgctcgtgccagcgccagctaccaccagtaacttccttcaactctcaaacctcacttctctcccagtctctctctcacacttggccctcaaactcacttgtgtgtcgtaggtgaagagaaggaaatgatgaaaacaaagaggagggttttctttggggaaggggggtccatgagtgattttttagagaaggagatttgttgttgccatggggagccatggttcaagagaagaaaaaaagaaaatgggttagaattattgttgtgttgctgccatggggtttcaagggaggtttggggggttttggagacacaatagcggtggtgtggagctagtggaggagttggttggggactggtgggggtggtttggaggattcggggacttaatgatgtcgtttttttacttttttctataaaaaaataaaaaatcttacgtgatcggttatcgatcacatatgaagataatggatttcgactaacggcaggaacttcgaacaaagctttttaaatattagggacctatcacaaagcaaaaatttattagggaccaaatgcaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatattttctgttcgagattgattgaaattatcttatttgcttaacatattaaaatgcgtcatttttaatgatattattggtctatagtttttatgtaatacatttaataatgtttagaaatatttgtatataaataacttttatctattttttcaccagagcctatgaaatgtaagcacaggtttgttaatgagtagcacaacatggacagtttgtcaaaggcccaatagcatctttaatgggattcttgaactcaagaaccctatccactagatctactattattcttattaagagttttttaagatggagattgggttctaggaaaagaactactattttttcaaaaatattattttttcttgtgctagtaaaatctaataatccaaattggattctactattagaataacaaatgatagaagttcttgcatcctatataacatcatgggactcacaaaaaataatccaagaacctaaaatggattctttgacaaaaatgttctaagaatctcaatattttcccacttaagaaatataactatcaaatcaatataatatgaaacgagttcaatctttattgattcacttgacgcaagctatatgcacaactgacataatagattttaattctaaataacatgcaataaaaatataacaaacctgttccggaaaaagcctcctcaaaatgaagcacattcagtccccccacaatttttacaagttggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaagataaccccttagcttcaagcacacagtgcgtaaaagctaaagatgtagaagatcggaacatgatccgatctagaccagaacaaaacctaaaaccaaactactaactgatctataattttttatacatcataaaactaaaaaaacaaagcaaactaagcacataatcttacaatccctactgaatttactaaaagagacacagatagttgaggtgggaaatgttgccaaaccagaaatgaattatcacgggaaagtatggctgatgtggttacaattaggagtcttaattcatcttaaagcattaatattttttaacttaacaaatataattaaagagaagtaacgaataagataatgatctaaaattcttgtattgattgaaaatagcgtaaaaagatgtttcaaagataatgatacaaactctttaaatgcaaatggttacatgcacaaagcacgtatatatatatatatatatatatatatatatatatatatatatatatatatgaatatatctacgtacattcatatatgtatgtatatgcaaacatatatacatggatgcatatatatatatatgcactaacaaacatatatacatctggatagagagaggatcagaatagcaggacaaagacaaacttgtatttgttgcttccatactagaattgcattttcttcagggttagatgcatcaactgtgtgggagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaacaagctttgtcgcattgaccgaaaaaaccaaggtgacgttgaccaaaaaatagtcctgacaagatgttggtaaaaaaatataatcggttgatatcgatcacaaacatcattgactaaggttaacaaaaaaatttctaaccgacattgatcaaaaaataacttcgaccaaggtcgatcaaaagaaacgtaaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccatttttttatgtatgtaatacggtaacacatgtacctcttgcagagattggggagaaattgcaacttttctttttacattttgccttaaaaaaagtgttcatatttataaaaataattttctatttaacttggatattttttctcatactactacactaaggtatatacaacctaaggcgtgtttcttaatttggagagtgatgcttgattgattgactaccaacgaaggataatctaaaaaggagaaacaccatttataatcctcatgagtgcttatgtcccttttgccttgaggtagatgagtcggtatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaagaaggaggcagatgtatggagggcggtgtgggcatcagaaattttggtgtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgccgcatcaatgttgcatggctttagacatgattttaaattgcaattatgattgcgttgcatgcaacgaacctaaaaatcttacattgtggataattatggaaaaatacaaactgatgtgatcataattataattgtgatgtgattacagagtcaaaatacattagcgttatgactgcaattatggttgctgactacattttaaaaccatgactttgggtgtaatggtccatgttcgaagctagctatctttctttctactgtcactggtgtatatgtttttggatcttaggtaattttggtaccatttaatacaaatcattttgttggaaaaaaaatacggtagcctacatgcaatatacaaaataaaattgaattactatatattatcataaatagtagagtataagaagtaaagaaaattctaaagataaacatgcatttaaaaacatatgaaagaattttttaactatatatataacatctttaattagcttaatagaaatgcgaaagtacaataaaaaagcaaaaacataataggcgtgacaaatcggttgcttatatacaataaagacaataaagtttgaaactaaaaccttatccagactatccaaatatccctaattaatcatgaaaaaattagaacagaagacatttaataactatagcaacagtaacagcagcagctatagctaatggcgcgatcaccgaatcggaaaacttttcatcattgaagtattctatttcactaaccctaagcaagatctcaagttgatcgcgtgcaataagagctggcatttcaatattgaaaaacctctcaattgagtctgcaagatctttaattttagttttccacggtaagaattcttagccacaaaattgtatttccctatttttgaacacttgtaaacaacctctttgctcttcctcaatagttgtatcagtggctcaagttcctgctgtgaacgacccaacatattcctgtacttacctatctcctgccatgtttacgctacatattttctagaatgttatttgaatttcattaaaaatcataagaagcaagtttgaatttttcagtgaaatttttacttaggtttagttagacaaaccctatttaaagctatattgttttgcttatcggaaccaaaccaattagttcggtttgaatttcttagttaaatcaagtctggcttaaaccaaatcgagctaaccctaggttaattgtttcaaaggtcgggttgaagctctttaaacttgagaatgtgttctacaaaccgaagtaccttattatttaaagaatatctaatatttttttgtttttacattattgttgaatccattttatatgattttttttttacaaaatattaaactttatttactaaataagatttatataaaattcatgaaggtaaaagtaatatttttatcttttaatgtaaggcttggtttcactttcgtccttcaacttttttttatttgatttatttcagtgatcatttaatatttatggattcttccttaaggaatcttgatatttttctatagttttaattgttcttcggttatttattcggaaattgagaggggatcatcacctccaaagatttcctcgctcccattaacaaaaatgtctaaacaattaccttccttctaaaatttttgtgaagtacctccactaattaaactcaacatattctcccaaacttcattttctttgaaaacaatgttgtctaattcaagacgctttgatataaaatatttagtcgctagaacgagaaaaaaaattgaataaaaagaagggatttttttcttcttaatgtacttcatgctacttatttgttggcaatcattattaatatatattatcttatatgagacaattttcaacatttaaatgttaattttgtaagtatcttggtagtatccttttttgataaggaatagatattattttgagattatattatgatgatgaattgtctcataaaaacacgaggcaagcacttgaaaggaacaaattctctaatttcttagtgggtagtgggagagaggaagtaaacttgcttcaatatgcaaatgacgcttgacgcactctttacaggagaagcaaccatttctaaggtgcttaccataaaaagcattttgagaggctttgaacttgtctcgggcctcaaaatgaatttccatcaaggcttttgtggtgccttgggagtggatattgataccttgatgaattatgcaagcttgttgatttacttgagacaaactatatgcacaactgacaaaatggactttaattctaaatagcaataaaaagatatataataaacctgtttcagaaaaggcttcctcaaaatggaggctacttcaatctagtacggtagttgacttactaagtacgaaacaacaaattattaagttgataattaattaaacatgattttaaatacttacatatttattcacatgtaactataaagatttagtaagagcataaataaaaaatgttgttataatatataattttaaatttaatataataaaaatgtgtttgcaaaatagaaatataaatataaagcgtgacaacacatgtttttcgttaataataataataataataataataataataataataataataataataataataataataattacaaatgggttttgacaaaatcatacctggcgaaaatatgcagtttagtgacggaattaatttgtgattcatgcaatacaatttgtaccaatcatcatcatcatcataatctctttttcgttttatttatcaacgttgctacttagtacgaaaattatttgcacaaaatacaaacagaatgatgctatctgttatgaaaggtaaatccacacgaattacacgaaatatagaatggacggttatgattttataaaatgaatatcgattaaaaaaatttaaaaggcatgtaaaaagagatttacagacatcaaacttcgtgcgacttttacaaaatcctctttcctaacacagcattatattttccatacacaaaccgtaaactatagattctaaagggtatacctgacttattaacaactttttaaaaactaatattcattaaaaataccaaataggttttgacataatcacacctcgttgcagatttgacaaaaaagaattctaccaatttatttttcgtcaaattggtgttaaaattaaatatatgtgactagtcaagtaggtgataacaagttgcagcacttgtatatatgagtgatgcaaaggattcgtgcaatttatttacgaaaattatatattggcatgaaacacacgaactgtaaactatatatagtcactaacttgtatacgtacgaactgtaacaataaattttaaaataaaatattaattacaaatataaaatgggttttgacaaaatcgatcacacctcgggcagatttgacaaaagataattcgccacgaattctttttcgtcaattatttaacacaaccttccttttacgaattgcacaaatccacttttaaaatacaagaaaattttgttttaaaaattcagccagccgacatagaggtgtatgcaggtaagtttggattgagtttcatcatacctatgacttaagaatgagttgatttgagtcatttgtatacgattttaattaaattattgggttaaaatatttaaatttgtatgctatttattaaatccaatatttatataagctaaaattcttattaattagaatactgaaaacattacttataaattaaatattgtcagatgctgcgactaagtgaggtggtggaaagatgtcaagagttgaactctaatttttgaaagaataacaatgacactcggtacttattcaactctcttgttatgcacgaaacatatatttaataataaattcacgcgcgtatttataaaattatatgagaattttttgtataaaaatttaaacacataaattatattaaattaaaatgttatggtaattttaaaatatgaatgataaaatgattcaattattatactttaatttttaaataaaaattgatttttataatatttaaagtttataaataatattttgaataattttacatataaattaattaaattaaatgcaaaaaactgaaattaaatatttcttaaaactaattaattattatatgaatcactttatattagtaattgcgagctgcttgtctcttctctcccaacggctcccgccattcaaagtttggagataattaaaagcaataaagtagcactgcattcgttacctctcttggtagagactatagaagtagaaggaagctcaagggtttttattttaaaaaatatataaaaaatgaatttaataatttttttaaattaaaaaataataggagcaaagagaagttgggttccctaaccccgacttctctctgcaagctaaaaaggagtgttgtttaggaaacaattttgaggcaggtgtattttgaaaaaaattgaggagagagcaagtgtagtggagtaaaaaaatcctataagattttgtttgatactaaaaagaaaaaaataattgtgatgagaaaaaataagttagaggataaatatcttcaacacttaaacaaacaaataaaaaagtttttctagaaagttcacttaaatctattttcactattgataaaaatttatacctgttgatttaaaataaaattatattttataaaaattatatttattaaatatgataggagaaaaatattttttacatatagtaaaatattttcatttgctggacttaaattttctttatctctcattttagtattgttgtttgagatgatctcactaaatatattttacttgactaataataaaaattttatatagataagattcaaaggataatcaccaaccaaaaatttttatggaagtatttatcaaataattacaatagatatataacataaaaaaagagttgaattgaataataatttttcatgccaaattactttaatcactctatattattattattattatcattattataacatcttcacaatattctttattttattagtatctattatttattttattaattttatttaataaaaaatcacaaacttttctttttgcacacatctttaacgtacatataaagatattcaaatcttgaattcattaatattatgtttttagggatcaattagcatgtgtcctttctttaattctttctcttttaatttgttcaacattttttttgtcttaataattttttaatctcatttttttattttcctcctaacaaaatttattctatatataagaattaataaaaatttaaatcttttaccacttgattaaaaaacataaatcattatcaattattttaaatttataaaatcatgattcagtattagatctttataaaataccatatctctatgacaattttaatgattaggttgaaatataaactaacacgaatttaagtaaatatttcactatttactttcacattgaaaaattgattttaaattttaactttagaaaaaaaattctaagttgaggatctttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagataatggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttcagtgtttggggctctgacaagttgaagtcgttgcctgatgagatgagtactcttctcccaaagttagaagatctcaccatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttagccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcataatggaatggatagcatttgatctttaataaatttttgctttgtgataggttcctaatatttaaaaagttttgtttgaaatacttatcattagtcaaaatccgttatttgctcacacgatcgttaaccagccacacagacatgtcatgtgtgatttttgtctgactgagattaggactaatgataagaaactatagtcaaaatcctttggacatcaaagaatcattcttcagcaaataacggattttgactaatgataagaaactatagtcaaaatcccttgggcatcaaaaaatcactcttcagcattcctctacgttttcacacaacccactatagtttcttctatacctttcttatggatttgtcactatgacttcgtcactcgtaaagatccaaggtgaagaggtcctcaccaacgatttttaggaccttgcaatcaattttgcattttcaaatcaaaccaagccaattcccaactcaagaaattcacatggataaggtttctaagagaacacatcaaaatagtttcatgggtagaagaaggtcaacaaaaccttaccctaaaatgtgattccgctcggtccattgaatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcagccaccactggtgctgccagtcgtgccactgctcgtgccagcgccagctaccaccagtaacttccttcaactctcaaacctcacttctctcccagtctctctctcacacttggccctccaacccacttgtgtgtcgtaggtgaagagaaggaaatgatgaaaacaaagaggagggttttctttggggaaggggggtccatgagtgatttttgagagaaggagatttgttgttgccatggggagccatggttcaagagaagaaaaaaagaaaatgggttagaattattgttgtgttgctgccatggggtttcaagggaggtttggggggttttggagacataatagcggtggtgtggagctagtggaggagttggttgaggactggtgggggtggtttggaggattcggggacttaatgatgtcgtttttttacttttttctataaaaaaataaaaaatcttacgtgatcggttaacgatcacatatgaagataatggatttcgactaacggtaggaacttcggacaaagctttttaaatattagggacccatcataaagcaaaaatttattagggaccaaatgtaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatatattttctgttcgagattgattgaaattatcttatttgcttaacatattaaaatgcgtcatttttaatgatattattggtctatagtttttatgtaatacatttaataatgtttagaaatatttgtatataaataacttttatctattatttcaccagagcctatgaaatgtaagcacaggtttgttaatgagtagcacaacatggacagtttgtcaaaggcccaatagcatctttaatgggattcttgaactcaagaactctatccactagatctactattattcttattaagagttttttaagatggagattgggttctaggaaaagaactcctattttttcaaaaatattattttttcttgtgctagtaaaatctaataatccgaattggattctactattagaataaaaaatgatagaagttcgtgcatcctatataacatcatgggactcacaaaaaataatccaagaacctaaaatggattctttgaccaaaaatgttctaagaatctcaatattttcccacttaagaaatataactatcaaatcaatataatatgaaatgagttcaatctttattgattcacttgacgcaagctatatgcacaactgacataatagattttaattctaaataacatgcaataaaaatataacaaacctgttccggaaaaagcctcctcaaaaagaagcacattcggtccccccacaatttttacaagtcggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaacaaaacctaaaaccaaactactaactgatctataattttttatacatcataaaactaaaaaaacaaagcaaactaagcacataatcttacaatcccttctgaatttactaaaagagacacagatagttgaggtgggaaatgttgccaaaccagaaatgaattatcacgctccaaattaactttggaagccaacctgcacatacgtgtcttcatgaagagtatgctgaagctggatcctccaatcttgctccagcagtgagctgattaagttgatgagggtagcatacgtgaggatgaaacttgttggttaattacttaatttcttcctaggacgagtctaagaatcagactcaaactaatagaagcctagattcaaggcatgacagagaccataaaagatggcatggagttcagccttgagattggtagacactccacacgatcttgatttcatattttttttcttaaaataactacatacatattaagtagcatggttttaaattatgattgtgattactttaaggtgagtcataaaatctttttatatattgcagctaatcactggaaagtatggctgatgtggttacaattaggagtcttcttaaagcattaatattttttaacttaacaaatataattaaagagaagtaactaataagataatgatctaaaattcttgtattgattggaaatagcgtaaaaagatgtttcaaatataatgatacaaactctttaaatgcaaatggttacatgcacaaagcacgtgtatatatatgtattcatacatacatacatatatatatatatatatatatatatatatatatatatatatatatatatatatatatatatatatatatatatatatatacgtgtgtgtgtgtgtgtgtgtatatatagggagagagagtgtgtgtgtgtgtgtattagagagattttatggttgtagtttgtagggggagagagggggagatggttggggggggagagcgtattttttttttttttttaatgataggtttgtggggagagagaagtggagataggaagagaaagagagagaatttatttggtatggttagaggttttatatttttttcntca

SEQ ID NO: 181 - DNA, 44129 bp, Glycine max
ctaggaggatctatttctttgttgtataaaatctttgtataaccttagaaattatgaaatgtaaagtcataaaaaggaatattgatatactctatattgtttctaagttttttactatccactttgtagtagtattgaataagtaaaattctatcaaaatctttcacacaaataaaatcaggtgaaatctcaatattatgattgggcaagatttccctcatgaatgatagaatctgaattttatttgattcttgcttgctggttgattttttcttaagaatttaacaaatatatcttttatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatttgaatatatctacgtacattcatatatgtatgtatatgcaaacatatatacatctggatagagagaggatcagaatagcaggacaaagacaaacttgtatttgttgcttccatactagaattgcattttcttatatcaactgtgtggaagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaaccaagctttgtcacattgaccaaaaaaaccaaggtgacattgaccaaaaaatagtcctgacaagatgttggtaaaaaaatataatcggttaatatcgatcacaaacatcattgactaaggttgacaaaaaaaattttaaccgacattgataaaaaaataacttcgaccaatgtcgatcaaaagaaacataaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccattttttatgtatgtaatacggtaacacatgtacctcttgcacagattggggagaaattgcaactttttttttacattttgccttaaaaaaagtgttcatatttataaaaataattttctatttaacttggatattttttcttatactactacactaaggtatatacaacctaattaaggcgtgtttcttaatttggagactggtgcttgattgattgactaccaacgaaggataatctaaaaaggagaaacaccatttataatcctcatgagtgcttatgtcccttttgccttgaggtagatgagtcggcatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaattaagaaggaggcagatgtatggagggcggtgtgggcatcagaaattttggggtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgcgcatcaatgttgcatggctttagacatgattttaaattgcaattatgattgcgttgcttgcaacgaacctaaaaatcttacattgtggataattatggaaaaatacaaactgatgtgatcataattataattgtgatgtgattacagagtcaaaatacattagcgttatgactgcaattatggttgctgactacaatttaaaaccatgactttgggtgtaatggtccatgttcgatgctagctatctttgtcgagatagaaatataatctaaccatggaatttgctttctttctactgtcactggtgtatatgtttttggatcttaggtacttttggtaccatttaatacaaatcattttgttggaaaaaaaactacggtagcctacatgcaatatacaaaataaaattgaattactatatattatcataaatagtagagtataagaagtaaagaaaattctaaagataaacatgaatttaaaaacatatgaaactaatatatatatatatatatatatatatatataataataataataataagagattgttttaactatatatataacatatttaattagcttaatagaaatgcgaaagtacaataaaaaagcaaaaacataataggcgtgacaaatcggttgctaatatacaataaagacaacaaagtttgaaactaaaaccttatccagactatccaaataaccctaattaatcatgcaaaaattagaacagaagaaatttaataactatagcaacagtaacagcagcagctatagctaatgccgcgatcaccgaatcggaaaacttttcatcattgaagtattctatttcactaaccctaagcaagatctcaagttgatcgcgtgcaataagagctagcatttcaatattgaaaaacctctcaattgagtctgcaagatctttaattttagttatccacggtaagaattattagccacaaaattgtatttccctatttttgaacacttgtaaacaacctctttgctcttcctcaatagttgtatcagtggctcaagttcctgctgtgaacggcccaacatattcctgtacttacctatctcctgccatgtttaccgctacatattttctagaatgttatttgaatttcattaaaaatcataagaagcaagtttgaatttttcagtgaaatttttacttaggtttagttagaaaaccctatttaaaagctatattgttttgcttatcgaaacaaaaccaattagttcggtttgaatttcttagttaataaatcaattttatatgattttttatacaaaatattaaactcaatttactaaataagatttatatcaaattcatgaaggtaaaagtaatatttttatcttttaatgtaaggcttggtttcacttttgtcctttaacttttttttatttgatttatttcagttatcatttaatatttatgggttcttccttaaggaatcttgattttcctatagttttaattgttcttcggttatttattccgaaattgagaggggatcatcacctccaaagatttcctcgctcccattaacaaaaatgtctaaacaattaccttccttctaaaaaatttgtaaagtacctccactaattaaactcaacatattctcccatacttcattttctttgaaaacaatgttgtctaattcaagacgcttcgatataaaatatttagtcgctagaacgagagaaaaaaaattgaataaaaagaagggattttttttttcttcttaacgtacttcatgctacttatttgctggcaatcattattaatatatattatcttatatgagacaattttgaacatttaaatgttaattttgtaagtatcttggtagtatccttttctgataaggaatagatattattttgagattatattatgatgatgaattgtctcataaaaacacgaggcaagcacttgaaaggaacaaattctctaatttcttagtgggtagtgggagagaggaagtaaacttgcttcaataggcaaatgacgcatgacgcactctttataggagaagcaacactttctaaggtgcttaccataaaaagcattttgagaggctttgaacttgtctcgggcctcaaaatgaatttccatcaaagcttttgtggtgccttgggagtggatattgataccttgatgaattatgcaagcttgcttatttacttgagacagactatatatgcacaactgacaaaatagactttaattctaaatagcaataaaaagatatataataaacctgtttgaaaacggaggctacttcaatctagtacggtagttgacttactaagtacgaaacaacaaattaatgagactgctgactactgatttcatagaaagatttaggaagatgaggagtaagaaatgtatggtaaagcttctaggagtagaatatgttactatgtcttaaagtaaaaaaatatttatgtttaaaagatgaattatgattcataattattttaattaaatataaataataaaagttatatataatatattattggatcataatttataattttatgtttgtattttcagtcaatacatttataaaacaatttagcataacatttatgaactaaatttaaaacctttatttaatattttaagattctttcattagaaacaagttccggtataggagttggtatcctttcaaatgatataaagcaatagatttaaattttatattctattttattgtgtcaaaataatgtattaaattctttggtaagagacactataattttaagttattaagttgataattaattaaacatgattttaaatacttacatatttattcacttataactataaagatttagtaagagcataaataaaaaatgttgttataatatataattttaaatttaatataataaaaatgtgttagcaaaatagaaatataaacataaagcgtgacaacacatgtttttagttaataataataataatattaattacaaatattaaataggttttgacaaaatcatacctggcgcaaatatgcagtttagtgacggaattaatttgtgattcatgcaatacaatttgtaccaatcatcatcatcatcataatctctttttcgttttatttatcaatgttgctacttagtacgaaaattatttgcacaaaatacaaacagaatgatgctatctgttatgaaaagtaaatccacacagaattacacgaaacatagaatggacggttatgattttataaaatgaatatcgattaaatttaaatgttatggtaattttaaaatatgaatgataaaatgattcaattattatactttagtttgtaaataaaaattgatttttataatatttaaagtttataaataatattttgaataattttaaaaataaattaattaaattaaatgcaaaaaactgaaattaaatattgcttaaaactaattaattattattatatcatctgctccattataattgttgtgtaaaaaataataattctaaaataatttttatttttattttttaatgtaaaattaattatgtttttttacttatatttcttatatatgaatgatgaactacaaaatttaaaaataaattattgatgatataaagttaattttataaaattattttttatttttttatttatataaaataatgtatgatgataattattttcagaagaaaagcaacacttttctaagataaattgttatagatgtttaatattatattttgcttgtaagacaaaaacatactaactactaaattatctaatttatgtatatttttagtcctttgcataatcgggcgataacttatcatatgaaagaatactgatgatgataaatactttttgaagaataataatttttatgaaatatttgaattagttttacattaagagtttctaatgatcttaaaatgattaaatgtattatattatatttagtaatatacttaaaaatttaaatattgttgtaattttaaaatatgaaaggataaaataattgaattattttacaatggtatttcaaacaaaaataaatagttatactttttttttataatactagtatatgtataaaatagaagaagatagataaataatacaagttatatccaattactacaagtacgcaccgatcaatttcaataaaaaaaaaaaacaaggtgtgagtgaagtcaacaattaagatagaaatgaagttggaagaatcatcgattttaagattgcattatatgctaataattgggctgactatatatacccaacaattaatgttgttatcgttgttgtgcttgtctagtgaatgatggcagatgttgtatttcaaggtatgggaactgcgtggcaatttctgaacgtgattatggtcataaaagacaaagttacgttcaaaacagcattggaaaacctccaatccattctaatacgcagcttgtttctgattgttccaaagtccacagcttaaattttgtggccaggcatcgttacaatgttaaactaaaggcatttacaaagtcatttcggaatatttactccacggtcatgttagctcagattgcaagagatcaaaaagagaaccgtaggagtcaaatactacttgcctacaataatcctgctcagtctcataagattctaagtattgttgatatatattaatattaagggtctatctggataaatgtatttagaagtactactaaaaaaatccatctcaaagcagaaaacgcccttattagcttcacagcaaagacagaaatccacgtcaaaaacattaacaacgtgttttcaattgcctccccagggtcgaagcacgttttctcaacaaccctaagcaatgtctcctctgatctcttgccatctgagcttgcatgtcgatggcaaatagtttcccgagctcgtcgaaaaaccggtccagtttgtccttgtaacaagccctagtcacaaagtgtagccaccggatttttgaacactcgaaaacaagctgtgtcccctcctccatctttctgataaacgattggagttcctccttcggaagctgcaactcgttgtttttctgttctatctccttgatcaccggagatatagctactagagtggatattggaggtgcaccaaagatgatttgaagcaaaccgttttgtttttaagttccaaaacggttcccagcaactcgttgaacacagctcccactgttgcttctattagtagtgccatgatattcacaacagaaacacgcacccacaaggatgaaaacaagatgaagaaataaacctctctttataatatatagagtcaggttaaacgtaatgttaaaaaggaagtttcttggaactccatttctatcctgttgactttacgaacttgtagctaggtatacttgtttgtattatttaccgacttgaacatattttaattatttatttaattaactgaatagttataatttccttaatagatgcgagatgccaaatcttgttccaccctccaaccccaaggataattaatagttaagtgtgaaatagtatgtgtgtgtctatctatatatatattataaaattttttatacaattatctaattataacatattatttatgtgagaaatttattaattttttaaataattcaaatgataatttataatcagatgaccgtgtcaaattattttataccatcaatgaataaacattaatctctctctctctctctctctctctatatatatatataaattctaatcaaggttggttgaaattatcttacactaaaactaccattattcttattcaagagtatttcatgatgaaggttggattttaggagaaaaattcctaaaaattcctttttttttttgtgcaagtaaaatctaagaattcaaattgaattttatcattggagcaaaaaatgatagaagttgttgcattctatatagcatcatatgacccataaaaaataatccaagaatccaaaaaggattctttaaccaaagatgctctaagaatctcaatattttctcacttaagaaacataactatcaaattaatatactatgaaacgagtttaatctttagtgatttacttgagacaaactatatgcactactggcataatagactttaattctaaagaacaatacaaagacaacaaacatgttccggaaaaaagcttcctcaaaatggaggctacttcaatttagaacactcacgtgaagtgtattgtataacatgtctccttaggtcagaatgagagctttttattcgtgcttgaagcacgcccccttcaatttttacaagtcgaggtctttatgttgtatcaaaatgttcaatcatatccagctaatgttgtcgtgcaattaactttatgatagttgtcccttcatgatgactaactgtcgtaccataaacaattcattaatcccttacttttgctagcgagaaaattgttgctgcagtccactgtaatatcatttgttgcaaaaaattttgcaacgatatttaatgtcactaccactcttaacgctttcgcaacaaaaacttctactatttgataactacgaaaattaggcttaattgatagtcaaatttaactaaaaatgattagaatttctttattttattattatttttaatagaataatgaggattttaatatcattttaattcttctttcaagtttttaatttctcctcctcagtaatctagattccataagatacttcttgaagtgcagctatgatttttttttttttgtattttaccattcttttcttaaaattatcatacataattatatatgctatatacttgttgttagggaagaagataaaagttggttttcgaggatcagggcctccactgagaaaaggataagggaaggaacagttgtatattccattgattgatgctgttattacataatattatttatactgatttctcaataatcaaatttgtctttttgtgctacagaatatcagcaaatggttaagtttgtctacccctacagtacagtggcggattcaagatcctaagtcagttggtacaaattataaaaaataaaatcagtgggttcaattatataaatatagatgaaataaaatataaaaatataagattttatttacaaatttggtgaattttaaaaaatgaggggatgcaagtgcacaccctcagatggctgtaggtccgtcattgcttccagatatggtgcacctgcttgcaatccttgagctaagtgggccttgtaattgctctcttggtcttgttttctaattgcacccttttctgttgcttgcttgctgcattctcatcctctgtttctgcaactggttcctttgctacgctatcacttgtggtgccgtttttggcttttccagtcttcccaagttcccactgattcaaattccaaaagttctgcaaataaaattgaagaagaagctagaggtgggaaatacttaagtcattctcttgaaaaagttgcagcaatgatatgcaacaaaatatcactataccgagtcaaggtaattattgtgttcacatgaacatttctcccatgaaaatatatattttctgactttgtaatctctttatagtatgcatggaaaaataattttctgattttttttctctgtagtgttatatattatttttaatcacattttcttatttatttagtttgtttctgatttgacatcatgtgaatttggagatttgggttagaaatatttttggaattttcctggttagaacttgataggtccataatgaaggtatataaaaggatagggaaaagagggagagcggaatagaaaaagaaaggacaaatgggcctcaaaaacaagacatgcttgtgtatgacagcagaaagaatcagcagtacaagttgcactagctgaagtggaaaaggaacataggttgacataatggaatggatagcttgtaaggagagtgtacgtagaggctgagaataagttcttccttaagaaagggagtgggtctgggtttgttttttcctaattaccattctcaacatctggcttgtatccgccactccccttctctctgagttctatttttcatacttggaagcctattttttttaatataaatataaaattatggggatatctacctgtcaaaacttaatataatatattagtatctattatttatttattttattgattttatttagtaaaaatcacccacttttctttccgcatacatctttgacatatatgtaaggacattgaaatctttaattcattaatatatgtttttaggaataaattaacatgtgttctttctttaattctatgcgtatgggttaaccaatattcaaactctagaccatttagttaaaaaatacaagtcattactatttgtgtcaatcattattggtacactgcacaagtttaaaatctagttagatttgtaaagaaatgttatgttacatttcaaatgacttctgactttctttagtagctaaaaaacttgtttaactatttgataaacaagttttttcaataatttttaacattttttaaaacgttacttaaattaatatttttaaaaatactagtttctaacattttatatttttttcttattttatctttaatatataaacttaaatcttgaattagttagatacaagactatatccaatcccacttaactaacctcaagaaattagatgtcttatataattattaaatttatttaatacacgtctttcattttgtaatgataaaagatttactgataataatgcattccttttatagtattaattattttatttctattatgacattattttcttactctaatttttaaatatttttacttcataataaatataagaaatgtaatatcaaatattatattaaaattaaaataattttaatacgaataaaacaattaatcatatttctaatttatgcgttatgtttttaagctgaaaaataaaattaactgtaaagatttgggtttagttaaatttattcgtaattgactttagaaggagtaaattgaaatacacttttaaattaatatttgagtttctctatcaaaaaaggctatttgagttttatatttttattccgacgtcaaattctttgatatgtatagactatatttgagatacttttcgctttgaatttctatcacgctctgagaaatcaaatatatatatatttctcttgatcttaactttaaagtttaaagtgatatgagatttttacacatactaaaacaattttttctcaaataatgcatccattgatatccttgtctttgggtttggatccaagagtttcgacagcaatctgcgtacatctggtgcaatccagttaggaaatttgaactctcccctgccaatagaacatacaagatcataactccttctgtttatcacttccggagcagcataggcaggggcaccacatgtagtgtggagtaatccatttatattcccattttcatccagtagaagattttctggtttcagatcacgatggcacacacctcggctatggcagtagtcaacagcgctgatcaattgctgaaattatctcctagcatcatcctgcttgagctttcctttggataccttattgaagagctcaccaccttttacatactccataacaaagtaaattttggttttgctggccattacctcgtaaagctcaaccacatgtggatgcctggttagcctcatcgctgaaatttcgcgcttaatctgatcaatcatcccaactttcagaatcttctccttgtcagtaatcttaatggccacactcatgccagttatgatgttcctagcatggtagacttttgcaaaggttgaacaaggatagctcagatggaggcacggactcatcaacctcggtgaaggaattcttaactgtcaagcacatctttcaccattccctgattttggtgatgacactagagaacaatgaagaatatggacttcttggaaagtttgaagaataattaaggaatgatgcagcacctggttagccttccaattacccagcagcagaatatacaatgaaagacacacctgaaagaaagatgaacaaatttaataagttgggatcattgtcagagaatataatctcctgaataaaattcttgaaacttctacaaacataaccagcataacaatttttataacttgtttctgatgtcatttttgaacaatcccaaaaccataaggcattaggtgagttttgatcatatttaaacaggactggattaaaaaacaaagtatttagcacatcaattacatttctctcaggtagtctagtcgtttttagagttcttataaataaacgattcatgaccaagaagaacaacacaagactaaacaagtatgacagaaatgtaagattgtcaaaaatcaagaataaatcgaaaccagagatggccacacattatgcagaagaaataaaatttaatcaaacaatcaatcagcagatggcagaaagcacactaatacaacaaaatacatcaataatgaacttgagattcataaaaaaggagcatgcaaacaagtgagacctgcattctgttttgaattacatagacaaatcaagtcattcacactcatctgcccaaattaatcgtctaaagttgggagagtttaatgacactcgagaagaaaatgaaaattcagtaaggtttcaaataagcaagtataaatataactgagttgccaccgttttcagatgaatgtggttccactttccattacaatcgttaccgtttggcagtctatctaccaattttcatgcttgggtcacatgcactaagttattgtcaatacatattggcaacaaattaaaattttccagatgaaaaaaaaaggaaaaaatttacaaatttgccgataagagaaaaaggcaaataaacacaaacacccctctcaccaagagagagcttaactcatgaaaataacaaccatccacctataccagaatttggttttaaaatatcataattttgtactgtttatttttaaacatgttattatttgtaaaaattgaccaaaggtgcacttagatcttctcatgctacacaaaaatcaagtttaataaacattaagaaatatttgttacatttaataagggagattttcataataaaaaaaattctgaatttcaataaaaatacatttgatgatctattttttgtagtataaaatctttgtataacattagaaattatgaaatgtaaagtcataaaaaggaatattgatatactctatattgtttctaagttttttactatccactttgtagtagtattgaataagtaaaattctatcaaaatctttcacacaaataaaatcaggtgaaatctcaatattatgattgggcaagatttccctcatgaatgatagaatctgaattttatttgattcttgcttgctggttgattttttcttaagaatttaacaaatatatcttttatatatatatatatatatatatatatatatatatatatatatatatatatatatagattttaatgcattaatatacttagattagatacattaaatttcaaatttctgtaacaacctttgtgaattataaggaaagtctggtcaactaaataagctaatttacactcatgcatacaatcgcttcacttgaacttaactcaatcgtcatcatcattattatagtgagttaatagaaatgcaagattctcattactaaaaaaaaatagtcattactaaaaaaaatagtcattccataaaaaaatagctataagaggtcttgttaataaatattcttaaatactaagaaaacttaaaaatattaaataaaaatataatattagtatattaaaattgtttgaaatttaatttattattcaaacaatttgcttttttaaaaatcttaacaatttcacttgttacaatgtgacaaaacattcaaggaagaaaaaacaaagttaacttatatgtgggagtgagaaataggacaacaaatgaggctataaaagtaatatattgttgataaatagaaaaaataagttatataataaaattgtaaaacaaatttaaaacttcattcaataatattttatcatctataataattatgataattatcttaaaaatcatattaatgatgatatatgagtgaatgataatataaaattaatttatacttaatgcatgagtttaaattatagaaatattcttaaatattaaataaaaatataataatagtatattaaaattgttaaaaatactgtatagtttatcgttcaaacttttggtcctttattaaatcttagtaacagctcccttgttacaaagtgacaaaatcttttgggtatgagattggtgagaattagggacaatgaaaatgatggcatgccaaacatcgctaaattgacctaatggggttagttttacaaactaattcccagaataggtctgttttaaaactattttcaagggggtttcttttttacgtagattcagccatgcatgcatgtatatcgccagcatgcatgtatatcgtcagcatgcatggcgaaatacgcctgcactggacatgtggctattccgccagtgtcactggcgagatagctggcacagtttttgccactttgactggagatttcggtgcagagggcgcaggcaaggtgcaaagggcacaggataacagtagggcagtagggttcaggctaagttggttttgcaatcagtgttggcgaaacaaggagcatatatcgccaatggtattgacaaaataggtgtgttgtgccctttaagtagcaacttcatgttgatgctttcgtgctgatgctttgtgcctttaaaaatttctgagtgttctaagtgtttttaaagtttctctcaatcagtaatttctcttctctggcatcgtttttatttatttgaagtaattattttgagtctggaataaaatttgagtttcgactggcatcatttttatttattaatttctttggcatttttttatttatttaaagtaattattttgagtttggaataaaatttgagtttcgagtattttttgtaattagatttgtttattttgaagttattaatgttaagattaattatttataataacaacttctttaatgatttgttctgcctttaaaatgtctactttcaaaggtttccgttctgcctttaaaatttttactttcaaagcgttcaagttttttaagtttctgcatcatataattaattttttgttagaataaatttttaatctaaagtttgagtgtagtatttttttaattatatttacttattttgaagttattagttttaagattaattatttataatagcaacttagttgatggtttgatgtgcctttaaaatttctactttgaaagcgtacaagttttttaagtttttggcatgatatttatttgaagtaattaattttttattagaataaagttttaatttgaagttttagtaacaaggttttttgttattagaatacccaaaataatttaaaataacaaaacaaaaatttaaacaatatatattccaaattcatacaaactaacataccatatatttgaataataacttaaaatacctaaaataaatataacatccaaactttataatacctaaaactaaaacaaataatttaattatgaccaacagaaaaaataaaacacaaaattttttaactacattccaagtttgaaaaaaccaaatatgggcgggagaacatgcagctcacaagctttttgtcaccaccaaagcgtaacgtaacaacaccaaaccactactaaaaataaaggccttgtacatcggttataacgacctttctacatcggttatgacgcgtggtggtaacccggggtcgttgaatcacaacatcggttttatgaccgtctttgaaggccggcttttctacatcggttgtctagctacaaccgatgtagaatgggtaactttctgcagcggttctcaggctgaaacgatgttgaaagggtagatttctacatcggttatcagtcaaccgatgtagaaaatgaaaggtttctacatcagttatagttcaaccgatgtagaatgactagatatggtaacgttgctacatcggttatcaatcaatcgatgtagaaaatgaaagctttttacatcgtttatcgtaaaaccgatgtagtatggggagattttcaacattaccttgtattggaggtatattgatcctttcctttagcaataaaaaatcgaacacgatgtcccaactatacttaattattcaattcaagaacctgtgattacaacaaaaaattgattttcaggttcaagtcataacaactgagtataactaagagttttctagaacttattagtatggtactgtatgacatggatgacaggatgcgatttctcatcacagtataaactaaaaattcttatgcatgtgtagaggctaccacttaatgttttctcatatggctactacaagtcacaattttcttgtgcaatgactaaaatttaaaataggaactataaggcacaaagaaatagtttaaccaacgaatttcttgtaaacatagacaaaagtcagaatggaaggacctcaaaatgacctggcaatagcaattactaatttgataacttataatatcatacattgggtacaaaatgaaaaaataaaatgttataaacatataatataaagaaaatgataacttaatcatgtaatcattttgttttcttctaaatttcaagaaaaatattgtaagtagtattccaagtggaagcaataccaatcaagcactggacaatttgaatctctgtcaagaaaaaatgctactgtcttatggtatttcaagtagagatgacttctagcgtgtcacaggaaataaaaaccatctattacgaaagatagatgtagaaaattaaaatgaaaatagtactgtatgcatcaatcacaggaaataaaaaacaggcaagaccctcgatattgttcatctaacacgtgcaaaatatattattatactgtatgaagtattttgatctggtagtataattagggtcagtgcttgagcagttcagaacagagcgctgcagtgcaataaccaagacaacaaggactgactttttttggttgcacaataagtactgtctgacactatgattgccacaataaatagtttaagagcaaattagtaataaatgtcagtttgatttaaacaatagtattacactcctgggctcagtgggcttcatgcatcgagccaagtccagcgaacgtgtaacacgctccaaattttatttaataaatttgttactatttaatttttaagtattattttgtgcaagttgaagcttcctcagttccatagcactactatagcagcaatgcttaactagacactcagaagttaaaatagaaacctgaactattaagtaataaaaaccagttaactgttataaacaccttcagagtatatcagtatattccatatacctaggcttatttttttggaggcaagaagtttctggtactctgctgcctctgattttgctttggcaattctcttcttatctgcaatccttgccctctttctttggagggtcaggggagtgaccagccgttgtatcttaggacctttgctcacctttttccctacaaccaaacatatgcaactcagactagaaatcatcacaatcatgtccaaaaataatctccttcaatgggtcctacccatcaaacaacagcataaatatgcaaaacaaagttttcaaatttgaacgagaagtgatagatcataggagataacctcttacgatacatgtactaattttttaagattatcaaaaagaatgacctgaagaaaacacatttttatcagaagtcctatttttgctacacacacaactctgaatggataatttagataaattcttactgcaaacaaaatatatatacaggaccacagataaatttcaaaagaaattttcaaaaaccagataagctctgttaatgtggtcaccttaaaaaaaacaatccattattaaaaaaaaaaaacttacataacatcacgtaaatttatatatttcatagaatgatataattttttttgtctctatcaattatatgaagctctataagcttgttcaatggtaatagaggcaattagaaggtaagacatgcatgtgtactttgtgagaagttaaccaactaattcatttgttgtgactttgttaaaaaaaataaaaattgtgaagaacggcttctctgccaacacaaccaactttagtcaattagggtgtgttgtttggagaaaaagaggataaaagaaagtagaaatcaacaaagtgagattcacatttctacactttagttttaaatttttatctcactttaattttttttttcatttctttccactaacagacccttaaaaaattgaaaaaataatgtggacaatttagtcaactcactaacactattataagcaagtgggttttaaattttgaaaagcattacgcaataaaaaaaattaaatgttaaactacaaatcatgaacaaaatcatatatgggatttactagatgagaaaatccattgtttaatttccttgaaaaggaattattactcgggtttttttttctaagcaattaagcaaagagatatcattaataaaaaagctagaagactgtacaagatttacctaggccaagtcataagacaacatacaaagtttagaagcaaatacatcagaacataaaaaatgcagtaaaaaccaggatcatcctttaccagtaaaaaccaggttctcatccaaacttggccttgttcctctctttctcttttcgtgtacccgttgctaaccacgaagcttgatgaccatgacatgaccaaaaataaaatatatcagaaaatgataaggtcgaataatacgttaaagggcaaggtagatcagcagtcgtaaaaagtactttttttagtagtggaagtctatagttgtatacctctcagagcaaaactactttctattaccatcaagcgcttgtttctttacaaattacataactaaacttgcccctctttatattcattagtattttcaaatttcatcctttcatcttttgacttttaatgcttctttttcctgttattaacattgcttgttacatgtttttttagttaagggtagtggattgattaataagttaaatagttgaatagttactaaaaagttgtatagatactaaacttgtatagatagaacatgtatctttgggcttattttaactaattacatttagttgattttttttcttctcatttattattgtcttttttggcttaatcgtgtttgttaacagttgtggtgtgaagtattaatgaggatgggatttgaagcttctttacacggtttggttttgtattttgcagacaaattcattaccaaggcaaggaccaaacacaggtcttgcactccagctaccaaacaatgcacctgcctggcaaggtcctaacacaggacttgcaattcagccctcaatctggtgtacaaaaacttgtaatacatttttgtttccagggcgtatttcaatctgtttgtaagatttttaagatactcatatctgtcatacacaaattctcgtgtagttgtttgagtatataatgaaagtgttaaaaagtttcatctattacatatttgtattaatggagggaagaagagaattaggttttatgtataggataggataggatagaagtatatgtagaagttctttttggttttactatatcaaattagatgttttttgtgaattgtgatgaatgttgtcatgacttaaggcttaagcacagcaggattggtcaataacagtagttcattatgtggaaaaaccccgaggcttaattaccacattaacatcttattttgctcaatgtaagattcacaacattgctactccctttaagaaacatgttcatggtggcttcgctctatttccccttacattggcagactctcaaataataattcagtacattgcatcttactctagcctataattaggtatttcagcagctaaactctgaattaccacccatggtgccttcacttggttccccttacattggtgggttgacacaccaatgtatgcagtagattgcatatcataacagcagaccaataagttgattctcattcattctctattgtcatcatactgtcaatttgggtctgcaaaaatgtctacccaaatacacaaaatcttacacaattacaagcttgaggaattgacttcactaaattaaggcacccagcaaaagacaattggtgagccttccaattagagaggtgttgattcactttatttaaaataaattgaaaggaattcctctacactttttttatgaaaattgggattcccaaatactctaccaggtcatcagtatgttgatacctcattctctgccaaatagcctgctttcactgccatcccacattattagaaaaataaatacgggtattatcattactaaccttttggcttgagctcttagaaaataggtcaataatatgaaccatcatcttcacttgttcctcactagcttccgcataaaggagaaggttatcaactaacgccagatgagacaatttacgtgttcttttaactatctgaataggcttccactgttttgcatcaatagcaatttgaattaagtgaatgatgaggacatgaccaagagcaagggcaaggatccacttgaaggacttggaggacatatgacaagggctagagcaaggaaagccaaggaagctcttcaacaagtactatccatactatttgaatacaagcccaagtttcaaggagaaaagtccaaggttgtgagttgtatcatggcccaaatggaggaggactaaatggcaccactttgtctcaattttagagtgtttagtttgtctaaataatggctcaatccttgtaaagttggttgaccataaatatgttttgggttaatcaactaaaagagctttagtttggtttagttcaagttgtaataagggcccaattggcaacctaggcatcagccttttgggagaccaaatggtggctagcttgatggctgttgggggtgacttttggttgccacaattttagttacacttagccattaagttcttttaattccctaggttagtggcattaagttctttaattctaggttagtggatcattactaaaatctgatgtaaagcttttatataagctgaaccattttatcaataaacacaagttgagttttattcagaaaaatagagtttatctcttttatcttagtgagagtgattctcctaagttcttgagtgattcaagaacaccctggctatatcaaaggactttcacaatctttgtgtgtttccctcgccggaaagagtgattctttccttcctttcatcttcaaccttgttctttcaaaccacaattccaaaaaatccacttctgcccataattatctcgtggccataactcctgttttacgcgctcaaattaagtgattcttgagcctaaattgaatttcaaaacgagatctttcacctcgttttggaatcacctcatttggagccctgtatcttgagttattgccatttctatatttctgtccaaccaccacttaacctacgttttatcatctcattcttccattttatgccaagaaccaccttattaaggcccacgaaattagccaccgctcaacccttaaatcttgcaaattttccatcctttccttaatcaatttccgcattttccatcaaggtttaatcctagacaatccttagtcagcctttgtgcaatgaaggttcatatcatttggtatcagagccaagttctaggatcaacacttcctttgctggaaatattgggtaacatccttctttattctctttgccatttatattaccttcttattcatatttttttaggctgaaccattgcaaaagttaagccttttgatctctttgttatatatatattaaaaaagcagaaattcgtataagcaaaattaaaaacaaaaattgggctgaatggttcatgcctgaagaacttaaaaaatatatatatttaaggtaatatattggtagcatgaaggattgttacttgaattcctaaattctgaattttatttccttcatttgtgcctaaaaacattgttagcctttttcttggttaaccttttccttgtctctctagccttaccttacacatattggtgaattgttctttgttgtggccataatctcttgaattgcctaataactcaaggggaattagagtggtaaaaggcaagagtgtttcattagagaaaagccataattgtgtgatacacttgagtgggtgaggtattcaaacaacaactataattgtattgttatgtttgatttgtttgtttgagatgacaggaacaaatcctaatgatgaagtggggctttcgcaattccaaatgcaagctttgatgcaacatttggagaggttaatgaaacaacgagatgatgcactccatgagaggttggatcaaatggagaatagagatcataatgaagaagaaaggaggagaagagggaatgatggtgttcctagacaaaaccgaattgatggtattaaactcaacattcctcccattaaaggaaagaatgatctggaggcttacttggagtgggagataaaaatagagcatgttttctcatgcaacaactatgaggaggaccaaaaggtgaagcttgccgccacggagttttccgactatgctcttgtgtggtggaacaagcaatggttgatacatgggtggagatgaaaatgatcatgacgaagcggtatgtgccggctagttactcaagggatttgaaattcaagctccaaaaactaacccaaggcaacaagggggttggggagtatttcaagtgtcataccctaatttcgtccgggaacctttgctcgatgacatgcgaccattctttggtccttgtgaggtgcttggcacccatcattaggcaatttatgaaattccaggacatgccgaaaaaccaaaaaaaatattgatgcacaatccgtaagtttccgtgacacaccggaaatcaaaaggaagcatcgttgcataattaagtgaggttccgtaacattccgtaagtcaaaaaggggatgattatgtaatccgcaaggttccgtaacattacggaaagaaaacaagtatcgttacgaaattcgtaagtttccgtaactttacgaaaaaagaatcaccaaaaaaacagcagagggggtgtatttagtaaaaatgggggtgcaaatagcacccagacccacttgggccctccagaagattcctccagaaggcggttgcttctggaggaagcaaccctgctcgcctgggcgagctgggcggcaagcatctcccctattttgctataaataggggagaaaatgaagaagaaaaggatcccagccctttaggcacttctctctctttggaatttgcttggaaaaattgtttccgtgaagaaaatctaagccgaggcgcttccgaaacgtttccgtaacgttttccgtgaggaatctcgcaaaggtttgaaccgttcttcgacgttcttcattcgttcttcatcgttcttcgatcttcaacgggtaagtacctcgaaccaagcttttcgattcattctatgcacccgtagtggtccacattgtgtttcgtgcattttgattctcattttgtttactctttataccccctgttgacgtgcttaagccattttacttaagtcgtttctcgcttaacttaaaaataaaataaatttccaccgaacgtttgaattgtattatccattagcttcggttaaaataaattccgaccgttcggtcatgccgtaaccacgttggaaatcaaaaagaggtaaaaaataatataataatcaaaaagacatcttttagtaaaataaagcggaaaatcaatcggacgttttctctttgggatttctcattcttaaccgaattgattaataactaaagtgaaactaaggctaacatcaactcgcctagtcaagctcgtccacaaaaataagcttttgaagtttgtcatttcaatttctcactaagtaaaatggatcatttttaaggtccaacgccttaaaatgatcaccacttaagtaaaaaagaatcacttgataagaaagaactacgtaggtctgattttctcatcccaaattgaggaatacgtaggagcaaagggaaacacccttgtcgaccacaaaaaaggaaaaaatataaaaagggtataaaggatataagaacataaaagggaataaaaaaatcaaagtcatgtttgcacattcgattaaaggctgccgtcccttgggacgggcgtgtggggtgctaataccttccccgtgcgtaaatacaactcccgaacctttcaaacttaaaaattcgtagatcgcgtcttttccggtttttccgacgttttcctcaaataaacgttggtggcgactccgcacgtattcctttcgtggaacacgcatcccgcgagtcacgcgtcgccctcccgccgaagggtaggttgcgacatcaaggaaatggatgtgcttatgattcaagcaaagattgaagaagatgaggaggtaactatggctcgatttcttaatggtttgactaatgatattcgtgatattgttaagctgtaggagtttgttgaaatggatgatttgcttcacaaagcaatccaagtagagcaacaattaaaaaggaaaggagtggctaagaggagttttaccaactttggttcttctagttggaaagacaaaggtaagaaagatggggctgctacttctagtagttccacacctaccccatcaaaaactcgctcaaagtcccaagaggaaccctctaaaagaagtagagatgtgaagtgtttcaagtgccaaggcctaggacactatgcttatgagtgccctagcaaaaggtccatggttcttagagatggagaatatataagtgaatccgatgttgaagaggaagaagagagtgagtacgtagaggaagaggagactccggagggagatttgttgatgattagacggttacttggtggtcaattgaagcataaggaggagagccaaagagaaaacatatttcaaactagatgtttaatcaatggcaaggtgtgcatggtgatcattgatggaggtagttgcaccaatgtggctagtactagattagtgtcaaagctaaatttagctactaaaccacatcctaggccatacaaacttcaatggcttagtaaggatggggaggtacaagtaaggcagcaagttgaagtggatgtttccattgagaaatacaatgataaggtactttatgatgttgttcctatggaggccagtcacttacttttggggagaccatgacaatttgataaaagagccaatcatgacggttacatcaaaaagatctctttcatgcaccaagacaaaaatattgtgctcaaaccattgagtccacaagaagtgtgtgaggatcaaaagaaaatgagagaaaaacttcttcaagagaaaagagaaaaagaaaaagtgagcaaaacacttgagagtgagaaaaagagggaaacacttgagaggaaaaagagtgaacaaaagaagagtgaaacacttgaagtgagggagagctatttagccacaaaaagtgaggtcaagaggttgtttcgtgctaaatagtcactatacatcttgttttgcaaaaatcagattttaaccaataacacttttgatgattttgaagtgccttctagtgttaaaactcttttgcaggattttcaagacatgtttccatcaaatgtgacaagtggactaccacctttgaggggaattgagcatcaaattgatctcattccaggagcttctttgtccaataggccagcctatagaagtaatccacaagaaaccaaagagattcaaagacaagtggatgaactcattagcaaaggtagggtaagagatagtatgagtctttgtgttgtcccggtgattttggtccctaaaaaggatgagacatggcgcatgtgtttcgattgtagagcccttaataacatcaccattaaatataggcatcctatacctaggcttgatgatttgcttgatgaattgcatggtgcatgttacttttctaaaatcgatttaaaaagtggatacaatcaaattaggattaaagaaggggatgaatggaaaactgcttttaaaacaaaatatggtttgtatgaatggttggttatgcctttaggcctaactaacgctcctagcacttttatgagattaatgaaccatatcttgagagagttcataggaaagttcgttgtggtgtactttgatgatattcttatctatagcacttcacttgatttgcatattattcatttaaaatttgtcttgtgtgtgcttagagaagaacaattgtatgccaatcttgaaaaatgcatcttttgtactaaccatgttgtgttttttggattggttgtaagttcaaaaggagtgcaagttgatgaggagaaggttacggctattcaagaatggcctacacctaagtccgtgaccgaggtgaggagttttcatggcttaataagtttttatagacgatttgtgaaggattttagcatattggcagcatctctcaatgaagtgctcaagaaaaatgttggtttcaaatggggagagaaacaagaagaagctttcaatgttcttaagtaaaagctaactaatgcccccatacttgcattgccaaactttcaaaaatcttttgaaattgagtgtgatgcttcaaatgttgggattggggctgtgttgttgtaagaaggccatcgaattgcttattttagtgaaaagttaagtggtcctatccttaactattcaacttatgataaggagttgtatgccttagtacgggctttgaaaacatggcaacactacctttatcccaaggaatttgtcattcatagtgaccatgagtccctcaaatatatcaaggggcaaggcaagcttaacaaaaggcatgtgaagtgggtggaattcctagagcaattcccttatgttatcaaacataaaaagggaaaaggtaatattgtagccgatgctctttctcggcgtcatgcattactttctatgcttgaaacataattgattggtcttgaatgtttgaaaagcatgtatgaaaatgatgaaacttttggagaaatttttaaaaattgtgaaaatttttcagaaaatggttactttagacatgaaggctttcttttcaaagaaaacaaattgtgtgtgcctaaatgttctacaagaaatttgcttgtttgtgaagcacatgaatgaggtttaatggggcattttggggtccaaaagactctagaaacattacaagaacatttttataggcctcatatgaaaaaggatgtgcataaattttgtgaacattgcattgtatgtaaaaaggcaaagtctaaggtaaagcctcatggattgtatactccattgccaattccggagtatccttggattgatttatccatggattttgttttggggctgccaaaaacaagcagtggtagagattccatttttgtggttgttgataggttttctaaaatgggtcattttattccatgtaaaaaagttgatgatgcttcccatgtggctgatttgtttttcaaggagattttgagactccatggtttgccaaggagcattgttagtgatagggactctaagttcctaagccatttttggaggactttgtggggcaagttggacactaaattgttattttcaaccacttgtcacccacaaaccgatgggcaaacggaagttgttaataggacattgggaactttgcttaggacagttttgaggaagaacttaaaaacttaggaagcttgtttaccccatgttgagttcgcttacaatggagttgttcatagcaccactaattgttctctttttgaagttgtttatggttttaacccactaactcctcttgatcttttgcctatgcataatgtttctgtttttaagcataaagaaggtcaagcaaaggcggactatgtgaagaagcttcatgagagagtcaaaaatcaaattgagaggagaaataaaagctatgctaaacaagcaaacaaagggagaaagaaggttgtcttcgaacccagagattgggtttgggtgcacatgagaaaagaaaggttttcggaacaaaggaaatcaaagcttcaaccaaggggagatggaccatttcaagtgcttgaaagaatcaatgacaatgcttacaaagttgagctgcccggtgagtataattttagttccaccttcaatgtctctgacttatctctttttgatgcagatggagaatccgatttgaggacaaatccttctaaagagggagagaatgatgagggcatgaccaagagcgagggcaaggatccacttgaaggacttggatgacctatgacaagggctagagcaaggaaagccaaggaagctcttcaacaagtgttgtccatactatttgaatacaagcccaagtttcaaggagaaaagtccaaggttgtgagttgtatcatagcccaaatggaggaggactaaatggcaccactttgtctcaattttagagtgtttagtttgtctaaataatggctcaatccttgtaaagttggctgaccataaatatgttttgggttaatcaactaaaaggactttagtttggtttagttcaagttgtaataagggcccaattggcaacctaggcatcagccttttaggagaccaaatggtggctggcttgatggctgttaggggtgacttttggttgccacaattttagttacatttagccattaagttcttttaattccataggttagtggcattaagttcttcaattataggttagtggatcattactaaaatctgatgtaaagcttctatataagctgaaccattttatcaataaacacaagtttagttttattcagaaaattaaagtttatctcttttatcttagtgagagtgattctcctaagttcttgagtgattcaagaacaccctggctatatcaaaggactttcacaatctttgtgtgttgccctcgccggaaagagtgattctttccttcctttcatcttcaaccttgttctttcaaaccacaattccagaaaatccacttctgcccataattatctcgtggccataactcctgttttacgcgctcaaattaagtgattcttgagcctaaattgaatttcaaaacgagatctttcacctcgttttggaatcacctcatttggagccctgtatcttgagttattgccatttctatatttctgtccaaccaccacttaacctacgttttatcatctcattcttccattttatgccaagaatcaccttattaaggccaatgaaattagccactgctcaacccttaaatcttgccaattttccatcctttccttaatcaatttccgcattttccatcaaggtttaatcctagacgatcctaagtcttcctctgtgcaatgaaggttcatatcaatgaaatagcctctcaatgcataaaacaaaaaggtaaggagagatgggatctccctgtctaacccctttttctagtctaaactcctctagaggttcactattccaaaacatacgtatcttggatgaagagatgaaatgccaaataatgttcacaaagttctttgggtacccaatatcctgtaaagcatctcgaataaatgcccaattcaagcaatcataagctttctccagatcaatttttattgacatccatccatttgtagttttttgtgtctcattgaatgaaaaacctcttgggaaataattacattatctctactctgatggatgggaataaagttgacttgacaagggccaagtaatttctccatcaagggccttatacaatgagaaagaactttagtgatagctttgtggaaaacattacataagctaatcagtctgaaatccttcaatctagtcatatgtttcaccttggggataagagtgatatgtgtatcattaatctgatgcaccaattacagatcctgaaacacgctttgaaccaacttgacaagagcatcccccgctgtattccattgactttaataaaaaaaactgcatggaagccatcagggctaggagccttaaatgctcccatattcctaataatgttaagaactttttgtgaagacacatcaactccaagggaaaaaacaaattcctcatcaattagaggaaacatacttgttacagggaactcatcaacacactgatcatcaacaaataggttctggtaatattgagtcaccatacttttcaaagattccccatccgaaacccaggtaccatcttctccctgaagagtctcaactctactccttctcctcataataatagtagttccatggaagtaacttgagttatgatcccccaatgagagccatttggaataagctttctagaaccacaaaatctcttcctgtagcatcacaacctcatattccctccacacagaatacaacatatatgcctgggtggacttatccctctcacccatccacttgttaattctatccatccgcctgagaaggcttcatttcttagagaaaaaaaattcctaaacacatttttattccaatcttgcacatctttttgaaacaaacataacatatcaaaccaagacaaaaaagagttccaatgggaatgcacaaacctcttgaaatcatcatgagtaatccatgcagcctaaaaggtcttgtttgagagtgatgattcctttccacctctaatctaaccaaaaggggtctatgatccaatttaaaagggggaagatgcagcatcacagcctcttggaattttattctccactgcaagttaatcaagagcctatccaacctctgttcaaggttgcctcttttccaagtatatggttacctttgaaacccatcatatattaattcacagtttgaaatcatctattgaaagcttgtaagatcacaaagagatggattgtcagcacctccaaccctttcatgtggatgaagaatggaattgaaatcaccaatgataggctatgacttatcaatctcacaagctaactctctcaacacatcccacataccctgcctgcactagtaatgagaactattataaaccaccattaataaccaatcattagaactcttccaactaaccttcagatgcacatggtatctagaatttcccagcatctgaaccttccataagcttgaatcccacaagcagcaaataccactagagtggcccacaacttcttccacaacccaatccttggataattttcgtggcccttgcaccactagagtgggtctccataaaaaatattaaagaggatggatattcccttttgatatctttaattaaagaagcaaaaactctattggacatactgtgacaattgcaagacaaaaaattcatggaggcatagcaacatggatggccttaacatggccttggctaccctcttggcaaactaccatatcatcattctcatttttgaaactagcattactacgaccacctttaatttgtgcctcaccaacaatgcttgggtcagttggcacaacttccttttgcctctaacgctaaagactgctttctatagagccttaatcattttaagctcttagtccctatcaataatccttccctgtggtggttaagaaggttcttgactcactaagcttaaaacctgttttcccttcttagaggccttccctttattggcaattcccattttagtatttccctttatttgcttttctttcggcttccttaaaactgggcctgtgtttttagttggcccagttttaccctcttctaccacatagttcgtcttcatctccttaaaaacaactcccctattctgtttctgaacaccctttgggccactagtgctaggcccattagcattacgcttaactctagagaccaacctttcctcacgtgcttcattaagagcaatgaattttgacccaaatgatttgttgttgcgatcctcacatccctgtgctacaatcttggtatgattggcaaggccaaccccattaaagagaacttttaactaattcttcctcacactcctacgcactaattaccaaggcccgaaatgattggcattatcattactcaaaacattcacttgattttcgttttcaaatctggaccattaatattattcattacgccattatcatgcacacgccaccctgtcaactatctccaccttagccaccatatatctccaccagttttttcgtccctcggcttttgttgggattggatatccacaacatcggctttcatctccacagagtttgcatccttgtacccatacctcccacaattaaaatagatcaaatgcaatccttcatattgtagatttaataagtaacctctagcaataatcttaggctgcaaaggtttgaatagatcaatctcaacacagattcttgtgaaacaaccccttgcttggatagtcatcactctgtcgattttaagcattactccaggagtagaccctaatctccataagaattggtcgttgaacaattcaataggaaattttgggaaccttatccacaaccatcctccttccgacatgcagattacccaagaggaaaggacgccatctttacaccagaatataatgatcaaccaccatccatgccgccccccccccccccccatgaaagcatggttgtaatcctcacctcatcagatgtgaacaaaatctaatagtagtttcttggcacatcaatgatcaatgatcttgatagcaccattctttgcccactcacaattaaacttggcctcctattgctgaaaacccaatctcttccccatcaccatgaccatcaaggacccccttccatggcttacaccagtcactaaactccttatcggaaataggaacttctgggaaacgttcaaagtcctccttagatattggcgtaggaggtattttctgatctagatacccaaaacatctcccatcaaaagttgaaaaagccattggaccaccattcttcaaaagcttctctctatacgtaccatctggcacaccttgctcggcctccttatctttatcaagctccatctccgaattaccatcaccttcctcattaggcttcctattgactttcctagtactacgctggatatcatcttcctccttagaggattcagaagaaaccctagtagaactctcaacaccctcgattacaaattatttatccctagtgggttcctgatggacattaacatagctattcatttataagttacacttacatatatttgcaaggcatccatgaatatctatggatatttcctaaaacttaaaatataaaaataaaaataagcaactaaattattttatgagctctgcacaaataggcgctgcaaatatcactataaaatgataaattaaagagttggggaaaataatcactttcacaatttttttaattattcttctattttttttcctaaaaaatagtttaaaaacccacaaatttacattccttttctcccatataagataaatgtataagatttgtcatatttctggaaaaaaatgaaattattcaaattatctaaaaatttctctctttaaagtataaattcaaataaaactacacgtcgaaacatcaattatttataagtatatccatattaattatttataagtaaatgcactttagtggtagctggtatctatgagtatatggatagtataaaatccgttcccgttccatttacaaataggttaagaaaaaaacctatttcaattaattataaatactcatttaaatattcatttttccgtgacaaattttacctgtgagtattcacgggtacaagttttgaagtccttgcattggtttgcatcttttacacgtttttttctttcacaaaaaaggtatttttttaatacacatcttttacaagtatttaaggattcgtatcagtttttgtcatagtagtaactatttagtatcttttttcatttaagctgtcctctgcttattcatgataatgacggctaactgttaagtttcttcttgtatctgtttttattttattttttctgactttgcccaacggtttatgattgccgagctgctattggttccactaagcttgaccctgtaggaaatattttcctttttgctaatttggaattatgactattggtccaaacatggagataagatcattgcatttatccattttattgagattaattaagtctaaacataagttgaaatctgcccatgcaaccaacgtcctttcatttttaaataatgacataatatgtgtcaccgtcgttgctctcaaattcaattaactcaattgagtgaataaccaaacaactcgactggtaacagtaacatcagctatgtttcaatttcaaagccttctattctttcgaaatcgtatatatattatgttcgcctattttatcacgacaaccttatgcagagggtttattttgtgatgtacggaaaaaaaaattatttattccatgactttaaaataattattattttagattattttatataaataaaaattaataaatagatgaaataaaataataatttcataaaattcggtatcttaatattaataattactttaaaaaattaaatatgatatttattttgagataaatttattttcaaatataatacttattttaagaaaaaaatacctattaattatttcccacacagaaagaagcagacaaaagtgttcaaacgatgcatacatgtggctggaaataaaatataaatagggttatttaaacaactctttttctatgcttttgattattgattagtttcgcaccatttctggcttcagatgatacttggggtgtagatataaggggaaaataaattgggttgattaggtctaaatatgtattatcaggtttcaaattatagttggtttcgttcggtttttttgggtacatggcttgtttcagtttaaatctgaatatattaaaaagattaaaataaattaattaatttgatttaacattttgatttcgtagaactaaactaaattaatgaacaacctaactttcaattagggtatctttatgcaggacggaacgataaaaaaaaaaatcgaggaggggcaaaaatttaaaagcaaccataattaacttttactatcaataattattttaaactttctttgaaagaataattatttaaaacttagtctattgaaaaaactaaaatatcatatatcccattgttatattttaattgtaaaataaaatatagtgaaatagaatggtgtctaaataagttactatttcattgtttaaatatttttatgatgaaatgaaaaaaaagagtatttctatctcatcattctttaattaaaggaaaacatataaatgtaaaataaaataaatatattttatttcattccatttaaacaatacagtttattttttattatcgtcttattttaatgttattttgaataattaaataataaagtttgatatcattttattttattgcgcttcattctatctttctttctttttaatcaaattaatcacaagactatgggaccacttcctttttccttaattttcaatttttgcatgcacttttacagtatgaaaggcataagagagagattggggagctgcagctccctgttggaccattccatcaatcttcaaatgtggaaaaagaggtttgtataatgttctttcttcccatttttatttgtagattccatgctcacatgaagattacttttattatatctattgttttcctttgtcatttgaacttgaatgaagctccttctttcttttttttttttttttgtgcacacaccactgcaagaaaacagaggcacccagatataactatgttgctgctacgactggagtttgagttcttcattttttttttagataatttttttgtttttatctctagttactgaaattatccgagagtcttcattatatactgttggagtttgagtccttcattattaaaataaattcttggattgtaagtgatgataggataaattgtagccacaccattattttattctcttctaagcaaccacacgagatgggtttcatttccgaattttgaccctcccatgtattaataagttactcttgacaagttgttcgtatataaatctactttgattacttaaactagggagttgataacatatagatctactttaattacttaagctagggagtagacactagttattttttctttctttccatcaatcgtcaatgttttggcttaaggctaccagagataaaaaaaaaaaaatgacagaatcgaaataaataaataaaattaagcaacaacaaaaaaaaaaagagataatacgatggttcttaaataaccgtcttagaatgtcttactttctaagccggttatttaggaaccatctaaaatgtcgcatgttgatcaaaacatactaggacggttattgaataatcgtcttagaaagtaagacattctacgacggtacctaagaaatagtcttagaatgtcttactttctaagacggttattcagtaaccgtcttagatccgacgacatactaagacgggttgttactctaaaccgccttcgaaaatggatcattctaagacggctgtttactaaccgtcttagaaatctatattttctaagatggttgaaaaaccgttgttataaatatgatgctattttatgatgttgtattctatgacagttcaaaaccgtcatagaatgacaaatttaaccgacttagaatatcatatttgtagtggtgttaggctaatatttcgaatgatgctacttgttttccattgtccaacataaaaaaaaaaacccaaacgttagtaatataggaaagaaaaaattaagaatcaaggatcaataataacaccacgagtcaagacattttcatgattttatttgtgtatttttttatgattatccaactgaaaatattaagcaatactaagaaatatctggcaaagcttcttagtatataatatgaatgacattgaattataagcaatttaataagcctttgcctgagcctttttcatcttccaagactcggttggattctgacttgtagaacatggaaagaagaagggttcttggaatcattggactttgagaatgtggagacatgagaagcatcaaaggaggatcaagaagaatagattgtcgatctttcccaacttttcataggtaacaagttagcatccggtggtcatagtattaagctcttacactctatagtactggactcaattgtgagcctgtatacaaacacattagatggtttgtttgtttagctttatggctttttgtttgtgtaggaaaacacgaattcaactgttttgagttcaaaactctaatatgcctttccttgttttattttgcttatggtttttacttttttctttttatatactcactgccactttagtgttttgatgaaggatagcatttggtttgagcttgaatatacaatataaataatcaataatttttttttgttgtttataataattttatcatgttcaattagaattgtcttcccatgatatggtcagggagcagaaggtgaacttctgaaatctcaaataataaatagccttacaagacaccaacttgaactatttttttttctttccttttgatttttgtcgtgtatttatacggagtacaacacatataatactatatatattatatgcatatatgtgtgtgtggtcatacttgtcagttgcatttattatcttgaactgcaggtgtgtgtgtatttccatatatatgaatacgaatgggtcttaatttacactttattgcagcttgtaaaaagctgtgggtgtactgtatcataacaaaatacatgtcacaaggaactctgaggatatatgtatccgaacaagaaagagttgtactctctttcaatagaaactatactaatgttagctcttgacatacttaggggttatggagtatacaagaacaaagcaacatgagtttttaagaataaatctccattgacttagtaatgccacaacacttaaagagtgtctacctaaatttgatgttcttgtttctacaacttgtaagatgtcatctcattactttcaaaactgtcacttataaaccaatgtcaaaaaaaatatatcattgtatagtatatcgctggagcgtgcataacatcaaaagggactgagttcttggtgaggaactctggacaaatgattaacagaccacagagatttatgttggcttcccaaatttgctgaagctttcagagatgccaatttctggaggtggctaaacaactagttgaatgacgacattaaaacaaatcaagcagtagtatcaattgtagctcattatttggtaagcacagaccaaaatcatagcacctatcaaacccaaatctgaaaaaatgtagcatttgtacaagacattatacaatgctactactatgtatgtttatcattttcactctgaattatatttagcagtaagtcacatggatttggtaaaaaaataagggggaaaatgtaacgtgtgtgtaacagcatgactttgatatttacccaattttatatttttccctccagcaataatccccagagacaaaacttcaaaaatatttcagtatgaaattgcaataatgaagatcaattattgttagtggataaaaaaaaaagtgggtcccacactaattttaaaattatccacacaaaaggaaaaacatgttatttatcacattctatttttttcttctcccttccttgtatttttcagctgaaacaaacacaatgttacatctttgtacaatttcacttttcctcttgtcaagattaaagtctaggaatgctcatgagtcagttggatgagacatgataagttaaagttgagaatttacagctttgtacattgtcacttttcctcctgtcatgattaaagtctaggaatgctcacgagtggattgttggatgagacttggtaagtaaagttgagaagaacattcgaatgtctggtacaatgcaggaaatcatgcgataatacccgcaaattgaaaagttggcgacataaatatgattgaatgctcccagccacagataacaacagtaaaccattaaagtactattcgggcggtaaaaatttaacatgccatggtttcgacctcagtttaaaaaaattcttcagcataaacagtatacatgcatgttttaatgtagtaacatttgaattcttcgacatctggtaaactgttttaacattttccacatatatatcccacaagaataggttggtgagccattggataaaattaagccattgaaaagctttctacaaaagaaaaagaaataaaaatagaagcttttatctacctgagcaatagcttcttcacaaatactcttaaggccatccagatgatactcatatgtagcccttgagaggtcctaagcaacatccaaattaaaatatcaacaattcaatttcaaagacaaaaggtattatactagtttaaataatgcaactatgaaaatgtagaacagacggttcaatgaataaggaaaataaatcaaaataaacaaacgggaaaagcacacatatgagtaaaagtacctggggagttggtaatggaaaagcatcaaaaggagagactaaacaacttgctttggcagccaatttgtgaagtgctgctgaagcatcacccttctcctttacgcccttctcgcttgaagatttaagaatatccaatagcaattctaatcatgtacatttagcagcatattcattgcaaaatacttttaccatcatgaggagaagaaaaaagtttaaaatcatttattatgaaagaacatccaaacgttacaaatcatttattaccactattgtcaatgaatatagttttaccatcatgaggagaacataaataaacaagagcaatagttacacgtatttgaagccctttttctaaaaagcacataacagagattaggtgttccaatacctgccaaagaggaatagatacaaaaatcatatccaataacgtaaaaaaacatgaaaaaaatatcgttcaaaaactataagtagattataattctcaatttcacatctataactaaactaaatcactcacagaatttgcacgaaaactcactcgcccttgaatcttcttctctaatctttttaatgtgtttgctatgcaatctttcataggctgcaagttaaacgacaatcacaacaaggtgttctgttaaggaacattaataatgactaaattataatttaagaagaaatgcaactatatatggtaaaaatgaaaatctattactttaattacaaagagtagatgaacatacaactaatctttaaaatgtccatccttcggtttttgaaaaccaccagccataataatatctacaacaatgtcctataatacaaagatgttacatcagtggccgcatatcacattatcactgcacatcgatgatttctaaagggcagcacacaatgctgacaaagtaaagaacaaggaaattaacttcacctcattaccagcaagaccatagagggctaaagtagcatcacgttgaaggggagaattgtttgagtcaataatattgggcaaaggctctatagctccattttaagcaataacagctacgtgggtcctgaaatttgaattatatatgcaaaaaagggttatggaaggaaaaattataagaggaaaaaccaacatatatatatatatatatatataattcgtgaaacaaaggagcatattttttttacaccatttgtatacatttacctataaattaagaaaaatccacccttaagagttaggtttaagaaaggcaatcccaaattcagccataactaatgactgtagtgttagaggaatcctaaagcctacaccatggagtccccattcaacattaaccatttgtaagattgtgtagttatattatgaacacagccaaaggatggcaataaacatgttaataattgaatagagactatgattagcaatctatacctaagaatagcatcatggcttatcaaatattaactttaaataggagattatttgagaattttagatcaggctaattaattactgctatgataataaaaaatgcaatttgaatttttaaattttatattccttaacatataagcaagcgactaactttttgttgctactaataatcacctgtgccaacctcccaattgcaaaagccgacatttcccggagctctacatgtggagacttaagcatgtaaactaatggtggaatagcccctccttgggaaatatggaactaccacaaagtatggaagtcaataagaggatttcataactcatagatttatcatattacaagtttgcaatgcagaacttaatccacctttaaatctgaatttgttgcagcaaattgaccaagtaaaagggctgcttgttttttgcttttcaaacaacaagaactatcattgaaattatgaacttgcaaagaatacttgggggagaaaataactaaaccattaatatgaaggtagtatctgattttcagtaaacaactataatgttcaataaacatatcattcttctatatatggattgcttaatgattaaaggaaaaaccatgaccaaagtatagtgtaacctaagtaaacaaacgacaggtggtaaagccccggctagaagcacttctttcataatatctggtgacgagtggaccaaattttcaataacaacaacctacaaaaggcgctaatacaactagtgctagtagtttagaactctgtagaagcaaactaaaaaatgcatgcgattgtgtaaagtcatataagcatcttaccactacataacgtattataggatcctctgattgaagcattagtacaagagtgggtaatgcattgcatccaacaacctgcaatttttttattgcagaaagtcaactacctttgtggcattgaattcaagcaattcaacaagaggagggatatcaccttccttccagcatataccatacctatataagcataaagaatagaatagttgtagaataaatatttttaagccatgaaaaaaaggacaaaatcctgacacgggtcttattggtggtattttcaaagtcaagattgcatattgcatcagctactctcctgagaagaccgataactggaggagaaatggtactgatcttgtgcttacttaacaaatctacaagacaaggcaaggctccaacatctataatgagttgttgacgctctggttgtttgatgataaagataagaaaaaattaaaatcagagttaagatgctccatgattacgagggataaacaaacgtgacttgaaactgattttattcttaaacatatttttggaaccctcgtaccagaaattcaaagacacccataatcattttcctctaaaaaagggccacactattatatactactgaaaactcaaatagaaaacacatagagacgttacatgcacgcagtatggttgatgtatttaatccaatacacccatattcttcacttatatgttaatttggatagtaatttgtattattatttattcaaaaatcacccttaaaattatcaagactctccatctcactttttcatttaattaattaatgtgtgctagtcatgttattggatgcatccaagatttcatgggccgataacaaaaaaaataatttgtacccttttatatttaagtatttgaaaatataaagatatattatttaaaaaaagtggatacatagtttgattaaaaattacatttttttacattaaacaaataacataggtttaatgaaactcaaaatgatatatatatatatatatatatatatatatatatatatatatatatatatatatatatatatatatatatatatatatatatatatatatatatatatatatatatatatatatatatatatatatatatatatatacctatagatatccagatatatctgtatctccccctccctccctatccatttttctatatccacccttccccccgcccttttttcccccccttttcccccttcccccttctcgccccctctccacgtgtagggacccacctagatccagttatgctctagcaccccccctccctgcgtcttccatcctttttccagcgcctttcctcttttcccccctttcccccagctcccacatgcacccccaggggcggccctgtctctcccccgcaacttcccctcatttctcgcccctactctcgccccgccctggcgacgcccccctccccacccctcgccacaccctctccgctgtccgcgacgttctcctaccccttctcgcccgctggggtgtagacacctcctctccccccccctcgttgcctctctttcccgcgcgcggctgtctttctcctatctgacctcacacgctttcccgcaggggtctttccttttgttctcgcccgaggccccctggccgtaatccatgtgccgcctaaatccccgtttgttgcgcccacgctactccttgttgctcccccctgataactgttcccccccttgccgcgcggcgtattattacaattcttatgtcgtcttgtctttctcttttctcgtccccgccctttagtgtcggctagttggcccgcttttttcttcctctctccccc

SEQ ID NO: 182 - DNA, 72241 bp, Glycine max
  misc_feature (72089)..(72089): n is a, c, g, or t
  misc_feature (72174)..(72174): n is a, c, g, or t
  misc_feature (72224)..(72224): n is a, c, g, or t
atttaggtgacactatagaatactcaagcttagccctagaggggatggacctttccaggttttggagaggatcaataacaatgcctataggttggacctcctagaagagtatggagtcaacaccacttttaacatttttgatttaattccttttgaaggtggagctgatattgaggaggaggaactaacagatttaaggtcaaatcctcttcaagggggagggaatgatgcaatcctccctaggaagggaccagtcactagagccatgagcaagaggctccaagaggattgggctagagctgctgaagaaggccctagggttctcatgaaccttaaggtagatttctgagcccatgggccaaggttgggtccaattatctttgtacatattagattaggatgtcattatacttggtccttgtatttagggctccataatgtaggtaggataccctagaaatataggatttttcaacccttgtattttatggcacctagactagtttttgtattatgggtagttttgtaatttcacattcactaagtgaatatttgatgtgtgtgttgagaaataaatttaattgaattggtagaagcccaatccaattaaattttagagggggaggtgagcatttgcttactacaccccattgccacatcatatagtcatactttgtgcatgtccttcatgctttacatgcctcatgacacctaagcacaattagtggcgaatcttggaattgatcttggattagtgggctgaaccataactgcaattcactaattataattagtgaagttttggctccaaaatttggctccataaattcaagtgaaatttgaatttccctccaattttgtgtgacacttgggctataaatagaggtcatgtgtgtgcatttttttaactttgatcatttgaaaattaaacttcagatttcagagctcttttagagcacaaaaattttgtgctcttctcttcctctcccttcattcatctctttcttcctccaagctcttatccatggcctcctatggttgtgagcttcttctagactcatcttctccttgaagtggcatcttctttctcttttccttctccattccgctgtcattcatcttcctaggcctacaagctccaatggagcttacatcattatataaagaaggaacaagaacaaaatagatttaatatgtttcaagaatctgcaatgaataaaatcaaagaaaagaaatttcacacactaacagaatcgtaatttatatataattaaattaataacaagtaatgactaatccaatttagtcaatgaccaatcaatacatctataaatacaactactaattctaatcttggagcctacactaatacaaagatagtgtaaattaaaagtctgaattaaattggtaaaaacaaaatttttcattaaaagatgggtgtaagagtttttactcgcttaaattgacggttacacaaccatctttatttttaaaaaacaagaaacaatattcctaataaagaaaaaagtcgcttagcatcaataagatcccacaattgaatccaatatataaaaatgcaaatacaaggtgattattaacttgggcctgagacccacaacaactaaattaacctataactcaaaccccacaatattaatccattatgtacccaaactacctttgagtccatcggtaagcaaaaaaaaaaacaaacaaggatcattcacagcttaatttaaacttagattgagaagttcacatgaattatcaagttgggcttaaaaccccacgagtacaaaaaaaaaaccaaacccaatgaacacattttccacccacgaagacaatacaaaggtactacacattgataccaatcatccccaagcttagtattcccgaactatggatatgatatgacagagatacaaaatttgtgattaagattaaagaatcataagattcagcttcttcaactagcttagcttaaaacctttttggaccatgtttcgtgttaggaatagagagcacactttcagtacgaatatgagtcagttaatacaccaaacatcgcacattttcaagaacaaagagcacattttagacatgaagcaaaagcatttctcaatgaacacattttcaggtactaacctggggaggaagtcacgagggaattggacatgaaaccaaagaaggcttcaagtcgcaaggtagagataatacaaaacaatgacgaggtcgcagcaaaacatgggtgaggcagtgacggtgttacagtagaacgcgggagcacctttgtaatgacccgcctcgtcgttacgatatcaccactctaataactgaaaaattaaattctttttctttcttttatgaaaactccattatttttacttatgaaaatcatagtaaatttgaatttcacaaatatatatatatatatatatatatatatatatatatatatatatatatatatatatatatatatatatatattgtccccaaacacgcaccaatgtttgaccgaatacatgaatattatgtcattcatccacaatagatatatcgcatcccattcgttaaaaacatagtttttcttgaaagaaaatcagcatgcaatagggacatgcagatattctcagagctaggttccctgaccctaactatggtgtcaaaatagtaaattttataataactcccctcacctatcgtgagctctccgtcagtttctctttgcatcacttagaggtctctctctcgttcacgcttgtcagtccaacgcaagtctctattacaccaaaacaaaaggaatttagcataggcttcaaaaacaagatcaaaggaaacattcggggtcaaataccactgtcaaaacataagggatagaggggtatttcgggttctacagaaaagaaacatctttttgaaattccgatcacgccaatgtgaccggggtttagtgaatgccgcaaaaataacctcaaggtcataaaaagataacttttacaatgtctcattctctaggatttttcaaaggaagtgtaaaaacaccctataacagtacccaacacataagagacactaagaggaactcaaactagctaggagaaggcttagaagtcaaggttaccttagagaaactttgaaatggaggattgagggattttctccaccgaattctgaggattctgctctgattaaagtgttcctcttggtgtgggggtccaacggcaagcaacagcggctcatagcggccactggtggtcttgggtggtggaaaataaggttttagggtttgggagacgtttttgggggaagaggtgagtgaaattgtgtttttcacgctaaggacgtatttataacctgcaacatttgcttagcgggccttctgggcgctcagtgcacttcctctcggttggaaatgggcttagtgcagctttgggccgctcagcacaattcccctcggttggaattgcgcttagcgtgcctttctcgcttagcgggagactaaaagttattattttcaagatcccaacggtcagacagtaggaacatatcttagggatatccagacaaaatttgaagatgatgcaacagttaacgaatctggtgtcgcgatttcattgaactaggttttggtaaaatctaaaatctcatactttcaacttagctcaacaaaactccacataattcaacatccatatcaagaaattcacacatgactagttcaaggcatacttcaactcattcaagtctatcatgtagtcaaataacacaacaaaataatcaaacatcaaatataattactaataatatatatatcagggtgttacaaccttcgcgagtgatggtggtgagactgagcacgaggaccttcgcgaaggagaggactgtcacgagggtgagagtgagagctctggtgaagggtgagagtgagagcgagactgaagcgccatggacagagagagtgagagtgagaagcacgaaagaaaattataaataggatagcacaacgttggttttttccaaaaatcaatgttaacgcgttttgttaacaacaatttttcaaaaaaaatgatgttaacaaaagttcattaacattgatttctaaaaaactgatgttaacgaactcacatcggtttttgaaaaaaccgatgtcaacgaattcatgttatttatgattatgccatcgtgttttcattaacatcgattgtatcgaaaaatgatgttagcctagcgattttaaaagtatattttctagtagtgggagtagacaatggccatgaaatacctttccgacatttttgttagaagcagcgagtgacaacatcgtgcacatgggaaacctagatctattttttgaagatatcataataccgaccattgtttcttctttgtgacacccctatttatccttcataggcgaatgttgatggtgttggatcgagtggcctcagaataattaagaagggagggttgaattaattattcctaaaactttaccaattaaaaattactcttttaaggcttttacttttgttgttaagagaatatggagtagaagagaaacttaacagaaagtaaaagcgaaaattaaatgcacaacggaaagtaaaagagtagggaagaaggaaacaaacacacaagagtttttatactggttcggcaacaacccgtgcctacctccagtcctcaagcgacctggggtccttgagatttctttcaaccttgtaaaaatccttttacaagcaaagatccacaagggatgtaccctcccttgttctctttgaaaccctagtggatgtaccctccactagaactaatccacaagagatgtaccctctcttgttctcagtcaaacccaagtagatgtaccctctacttgtaccacaaaggatgtaccctccaatgtgttaagacaaagatctcaggctgttaaacctttgatactttgtgaatggggatacaaaagaattctcaggcggttaaacctttgaacgcttttgtattagggaatgggaagaatcaaaagaattctcagactgtgtcattttgaattctttgacaagggagaagggagacacaaaagaattcaggcggttagtccttttttctttaggaaaagggagaagagagacacaaaaagaattcaggcgattaatccttggcgaatggcaaagggagaagagaatgaaaaggatgaatagcacaggttttcaaggtttagaaaaccaaaaaacttcagaaagcttttggtacaaagaagaagaagaagttcaaagagattcaaggcttgtaaaggattgtatgaataattgttcaagattgttgttggaaagattgattcggaatgcaaaacaaagccttgcttttataaactcttgatgtctggtcaagaaggccattcagaagagttataactttttagaaaaacttaaaacccatttgaaaaagtcaaaacctttttgaagagttacatctttagatttttcaaaaacaaacactggtaatcgattaccaaatatgtgtaatcgattacacaaagcttttgagtgaaacaatgtgactcttcacttttaaatttgaatttcaacgttcaaggacactggtaatcgattaccaaaacattgtaatcgattacagccttttgaaaatatttggaacgttgtaaattcagtttgaaaactttttcaaactcattttcctactggtaatcgattacaacaatatggtaatcgattaccagagagtaaaaactctttggtaaaggttttgtcaaaaactcatgtgctgttcaaagttttgaaaaactttttaatacttatcttgattgagtcctttctttattcttgaatcttgagtcttgaatcttgatcttgattcttgagatcttgcatcttgaatcttgattcttgattgtaggctttcttcttgagtcttgaattcttcttgattcttgaactcttgacttgttcttgattcacttgagatgttctttgattcacttgagtttttctttgatcttttgagctttttgttcatcacctttgtcatcatcttttgttgtcatcattgttatcatcaaaacacctttgaatcattgttgattcatcatgaagctttgcttccacaatctcccccttttttatgatgacaacttcagaaatcaagaaacacacacacactttttcctagtcgatcactcttataaatgctccccctttgtttttgaatttatgcttatcttaaaattaaattatttactcatgtgagttcttgatttatccctatttctctccccctttggcatcaacaaaaagccaaagtgtgtatttaaacttaaagtatgcaaatatatcttaaacattcatacagcattcataaaaaatattaaccacaacatgaagtaaaaaccatgaagtaacaatcataaatagattaacttataaaatccacatagtcaaataagatacttgttcaaccaaaccatgcaaataaggaaataataaattgttcaaataccatagtaatatagccaaaatacaaggctgaaaatcaaagtagtaatattaaaatataagtctaagatgatggtggcggcggtggtggaagatcaaagcttgaccggatgtaagatacatcttcttcaaccttagtcattcttgactccatttcattgaagcgcatatccacttgcagttccaaagtatcaaacctctcaccaacaaaggtttgaagaccatcaaacctttccaaaatcttcgaaagaagagatgaatcttctccctcatgaccttcttcaccaatatttctagcacccttctttacccatgatccatcatgctccttaatataaccaaaggatgctatgactgaagcgcctataaggaatgatctcttgattggaacataaggttcagaatcaagagggatgttgaaatgttgaaggaagagggtaacaaggtgaggataaggcaacggggcattcaatcgcaacgccttatgcatgcgatatctaacaagatgtgcccaatcaatttgtaaacctttatgaaaggcccacatgacaatgagatcttcttcaaaaacctgggcaaggtttgaagatctaggaagcaaaatgcgaactataaggtaatggaggatgcggctttcaaaagccaatgaaccagcaagaagtcttccagtcatatccgcttggttggtgcaaaccaatcggcgggcatcatgcacagagaaatcgaatttccattcatcaatcagtgcaccctcaaaagtcataccttcactaggcaatttggttaagtcaaaaaacagggattggtcaatgaccatcttaatcccatagatttcagacattagaacaccttcatgaatttctaaattagaatagaaggcttttgttagtgcttagctttacttagttttaaaagattggctaaaattttgttaaaacataaagcacttagacaatgaaggaaagctggagttgctgcacatgatgtctaacattatgtcaaggaatcagattggggtgcacaatgcacaaggcaagataaaatgtcaaatgaagaattgaagctgcaggatccacgatgtcggatacaatgtccaggacatcctgcccgaaaatactggacacataaatctgttatatctttaacagattaatgtgcagtcagcaacagattaggagctctatctttaggaacgaattaaaagataattaaagattgaattacaaacttgaatagtttcgttcagggattagagattgaagataaaaactaaaagataaaactttatcttttagatctttaagtgcagatttttcaggagaatgatagagcttatccagcggaagttgttgcagcccagatacgtacactgctatataaacatgaaggctgcacgggttttttatcaagtcagagattgaagagttattttgtgagttttgtgacttgagtgttttgtgagccaccttgatgttaccctaacatcaagtgttggacctgagtgtgtagagttgatctctattgttcagagagcaatctctggtgtgtctttgatttgtttgtaaacacgggtgagtgattgagagggagtgagaggggttctcatatctaagagtggctcttaggtagaagttgcatgggtagtggttaggtgagaaggttgtatacagtggctgttagatcttcgaactaatactattttagtggatttcctccctggcttggtagcccccagatgtaggtgacgttgcaccgaactgggttaacaattctcttgtgttatttacttgtttaatctgttcatactgtcatatacaatctgcatgttctgaagcgcgatgtcgtgacatcctgtacgacatctgtcctcagtatcagaatttcaattggtatcagagcaggcactctaaatcactgagtgagatctagggagataaattctgatgaacatggagaaagaaggaggaccagtgaacagaccaccaattctggatggaaccaactatgaatactggaaagcaaggatggtggccttcctcaaatcactggatagcagaacctggaaagctgtcatcaaaggctgggaacatcccaagatgctggacacagaaggaaagcccactgatgaattgaagccagaagaagactggacaaaagaagaagacgaattggcacttggaaactccaaagccttgaatgccctattcaatggagttgacaagaatatcttcagattgatcaacacatgcacagttgccaaggatgcatgggagattctgaaaaccactcatgaaggaacctccaaagtgaagatgtccagattgcaactattggctacaaaattcgaaaatctgaagatgaaggaggaagaatgcattcatgacttccacatgaacattcttgaaattgccaatgcttgcactgccttgggagaaaggatgacagatgaaaagctggtgagaaagatcctcagatctttgcctaagagatttgacatgaaagtcactgcaatagaggaggcccaagacatttgcaacatgagagtagatgaactcattggttcccttcaaacctttgagctaggactctcggataggactgaaaagaagagcaagaacctggcgttcgtgtccaatgatgaaggagaagaagatgagtatgacctggatactgatgaaggtctgactaacgcagttgtgctccttggaaaacagttcaacaaagtgctgaaaagaatggacaggaggcagaaaccacatgtccggaacatccctttcgacatcaggaaaggtagtgaataccagaagaagtcagatgaaaagcccagtcacagcaaaggaattcaatgccatgggtgtgaaggctatggacacatcaaagctgaatgtcccacccatctcaagaagcagaggaaaggactttctgtatgttggtcagatgatacagagagtgaacaagaaagtgattctgatagagatgtgaatgcactcactgggagatttgaatctgatgaagattcaagtgatattgatattgaaatcacttttgatgagcttgctatatcctatagagaactatgcatcaaaagtgagaagattcttcagcaagaagctcaactgaagaagatcattgcaaatctggaggctgagaaggaggcacatgaagaggagatctctgagcttaaaggagaaattggttttctgaactctaaactggaaaacatgacaaaatcaataaagatgctgaataaaggctcagatatgcttgatgagatgctacagcttgggaagaatgttggaaaccagagaggacttggatttaatcataaatctgctggcagaacaaccatgacagaatttgttcctgccaaaaacagcactggagccacgatgtcacaacatcggtctcgacatcatggaacgcagcagaaaaagagcaaaagaaagaagtggaggtgtcactactgtggcaagtatggtcacataaagcctttttgctatcatctacatggccatccacatcatggaactcaaagtagcagcagcggaaggaagatgatgtgggttccaaaacacaagattgttagtcttgttgttcatacttcacttagagcatcagctaaggaagattggtacctagatagcggctgttccagacacatgacaggagttaaagaattcctggtgaacattgaaccttgctccactagctatgtgacatttggagatggctctaaaggaaagatcactggaatgggaaagctagtccatgatggacttcctagtctgaacaaagtactgctggtgaagggactgactgcaaacttgatcagcatcagtcagttgtgtgatgaaggattcaatgtaaacttcacaaagtcagaatgcttggtgacaaatgagaagagtgaagttctaatgaagggcagcagatcaaaggacaactgttacctatggacacctcaagaaaccagttactcctccacatgtctatcctccaaagaagatgaagtcaaaatatggcatcaaagatttggacatctgcacttaagaggcatgaagaaaatcattgacaaaggtgctgttagaggcattcccaatctgaaaatagaagaaggcagaatctgtggtgaatgtcagattggaaagcaagtcaagatgtcccaccagaagcttcaacatcagaccacttccagggtgctggaactacttcacatggacttgatggggcctatgcaagttgaaagccttggaggaaagaggtatgcctatgttgttgtggatgatttctccagatttacctgggtcaactttatcagagagaaatcagacacctttgaagtattcaaagagttgagtctaagacttcaaagagaaaaagactgtgtcatcaagagaattaggagtgaccatggcagagagtttgaaaaaaccaagtttactgaattctgcacatctgaaggcatcactcatgagttctctgcagccatcacaccacaacaaaatggcatagttgaaaggaaaaacaggactttgcaagaagctgctagggtcatgcttcatgccaaagaacttccctataatctctgggctgaagccatgaacacagcatgctatatccacaacagagtcacacttagaagagggactccaaccacactgtatgaaatctggaaagggaggaagccaactgtcaagcacttccacatctttggaagtccatgttacattttggcagatagagagcaaaggagaaagatggatcccaagagtgatgcaggaatattcttgggatactctacaaacagcagagcatatagagtattcaattccagaaccagaactgtgatggaatccatcaatgtggttgttgatgatctaactccagcaagaaagaaggatgtcgaagacgatgtcagaacatcgggagacaatgtagcagatacagctaaaagtgcagaaaatgcagaaaatgcagaaaactctgattctgctacagatgaaccaaacatcaatcaacctgacaagagtccctccattagaatccagaagatgcaccccaaggagctgattataggagatccaaacagaggagtcactacaagatcaagggagattgagattgtctccaattcatgctttgtctccaaaactgagccaaagaatgtgaaagaggcactgactgatgagttctggatcaatgctatgcaagaagaattggagcaattcaaaaggaatgaagtttgggagctagttcctagacccgagggaactaatgtgattggcaccaagtggatcttcaagaacaaaaccaatgaagaaggtgttataaccagaaacaaggccagacttgttactcaaggctacactcagattgaaggtgtagactttgatgaaactttcgcccctgttgctagacttgagtccatcagattgttacttggtgtagcttgcatcctcaaattcaagctgtaccagatggatgtgaagagcgcgtttctgaatggatacctgaatgaagaagtctatgtggagcagccaaagggatttgtagatccaactcatccagatcatgtatacaggctcaagaaggctctctatggattgaagcaagctccaagagcttggtatgaaaggctaacagagttccttactcagcaagggtataggaagggaggaattgacaagactctctttgtcaaacaagatgctgaaaacttgatgatagcacagatatatgttgatgacattgtgtttggagggatgtcgaatgagatgcttcgacattttgtccaacagatgcaatctgaatttgagatgagtcttgttggagagctgacttattttctgggactccaagtgaagcagatggaagactccatattcctctcacaaagcaagtatgcaaagaacattgtcaagaagtttgggatggaaaatgccagccataaaagaacacctgcacctactcacttgaagctgtcaaaggatgaagctggcaccagtgttgatcaaagtctgtacagaagcatgattgggagcttactatatttaacagcaagcagacctgacatcacctttgcagtaggtgtttgtgcaagatatcaagccaatcccaagataagtcacttgaatcaagtaaagagaattctgaaatatgtaaatggcaccagtgactatggaattatgtactgtcattgttcagattcaatgctggttggatattgtgatgctgattgggctggaagtgcagatgacagaaaaagcacttctggtggatgtttctatttgggaaacaatcttatttcatggttcagcaagaagcagaactgtgtgtccctatctactgcagaagcagagtatattgcagcaggaagcagctgttcacaactagtttggatgaagcagatgctgaaggagtacaatgtcgaacaagatgtcatgacattgtactgtgacaacatgagtgctattaatatttctaaaaatcctgttcaacacagcagaaccaagcacattgacattagacatcactatattagagatcttgttgatgataaagttatcacactggagcatgttgccactgaggaacaagtagcagatattttcacaaaggcattggatgcaaatcagtttgaaaaactgaggggcaagctgggcatttgtctgctagaggagttatagcagttacttctatctgaacgtgctcaaacttctcacttaacattaatagcacgttcactactgggccaaaacaaattcaacctccgtttcacacgttctcctacattcctcattcaaacttacattttcgtggcaatctcgttttcatcagcattccccaacacttctcagatattcacgaaaccactcccaaagctctgcttctccatggctacctcaccaaaagaaacctcatcccctgtttcaccctctgtaccatcatctccatcatcctccaaaactccatcaaaccaggaacaacctgcactcaatatccaatccatacaaatgattcctggtccaggccctgttcctgagaaactggtccctaaaagacaacagggagtgaagatttctgaaaaccctagctttgcaacaagccctagggaagaagacactgagatggataagaagatccgcagttttgtgaatagcattttgaaaaatgcttctgtccctgatgctgataaagatgtcccaacatcttccaccccaaatgctgaagtcctctcttcatccagtaaagagaaatcaacagaggaagaggatcaagccacagaggagacccctgcaccaagggcaccagaacctgctccaggtgacttcattgacctagaagaagtagaatctgatgaggaacccattgccaaaaagttggcacctggcattgcagaaagattacaaagcagaaagggaaaaacccccattactaggtctggacgaatcaaaactactgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctgtctgcagggaagctaagtgtgaagtatgcaatcctacataggattggcactgccaactgggtacccaccaatcatacttccattgttgccacaggtttgggtaaatttctgtatgctgttggaaccaagtccaaatttaattttggaaactatatttttgatcaaactattaagcattcagaatcttttgctgtcaaattacccattgccttcccaactgtattgtgtggcattatgttgagtcaacatcccaatattttaaacaacattgactctgtgaagaagagagaatctcctctatccctgcattacaaactatttgaggggacacatgtcccagacattgtctcgacattagggaaagctgctgcttcaggtgctgtgtccaaggatgatttgattgctgaactcaaggacacatgcaaggtgctggaggcaaccatcaaagccaacacagagaagaaaatggagctggaacgcctggtcaaaagactctcagacaatggcgttgatgatggagaagcagctgaggaagaagaagatgcagcagaggatacagaatcagatgatgatgattctgatgccaccccatgactagctattggggcatgtccctttgaacaattgattgttattggtctgtaatatttgcacattaatttcatgccttctacttttgccaaattctgtctaaaaagggggagtagtaggatattatgcatgatttatgaaggatattatgcatgatttatgattttgagggggagtagtatttatactgctgctgctgatgatgattgatgtaagctactgaaactagtagctgatagaagatgctgcagtgaactgctgcctagcagaatattcacttcacagcagtaagagcatggagacagggggagcagaaagctgatgtcacgtgagatgtcttgacatcctggaaaagacttgtagatttgcaacttgcagaattttgctgtcaccactacagatactgctgtgcttgattactctgataatgaaagttgctgatcccacttgcatgactgctcgtacctgctcaggaagtgtctaagtatgttttagacaaaatttgccaaagggggagattgttagtgcttagctttacttagttttaaaagattggctaaaattttgttaaaacataaagcacttagacaatgaaggaaagctggagttgctgcacatgatgtctaacattatgtcaaggaatcagattggggtgcacaatgcacaaggcaagataaaatgtcaaatgaagaattgaagctgcaggatccacgatgtcggatacaatgtccaggacatcctgcccgaaaatactggacacataaatctgttatatctttaacagattaatgtgcagtcagcaacagattaggagctctatctttaggaacgaattaaaagataattaaagattgaattacaaacttgaatagtttcgttcagggattagagattgaagataaaaactaaaagataaaactttatcttttagatctttaagtgcagatttttcaggagaatgatagagcttatccagcggaagttgttgcagcccagatacgtacactgctatataaacatgaaggctgcacgggttttttatcaagtcagagattgaagagttattttgtgagttttgtgacttgagtgttttgtgagccaccttgatgttaccctaacatcaagtgttggacctgagtgtgtagagttgatctctattgttcagagagcaatctctggtgtgtctttgatttgtttgtaaacacgggtgagtgattgagagggagtgagaggggttctcatatctaagagtggctcttaggtagaagttgcatgggtagtggttaggtgagaaggttgtatacagtggctgttagatcttcgaactaatactattttagtggatttcctccctggcttggtagcccccagatgtaggtgacgttgcaccgaactgggttaacaattctcttgtgttatttacttgtttaatctgttcatactgtcatatacaatctgcatgttctgaagcgcgatgtcgtgacatcctgtacgacatctgtcctcagtatcagaatttcagctttgactaattcagaatagacaggtaatttcagagacatgaatggaataagattggagttttcaaatgcttggaagcattcaaaattctcatttgagaagaactccatatctatgaattttgggtctacaatggaacgagaggaaaagaggtttgtgtaccgtatacgctgttcctctgatgagaataatgatccagagggaatggagggaggaattggtgcttcttgtgacccggaatgcagctgactccgactcgaagttccttttctctttttcgatggttctgccatttgaagagtttttttgggatttcaatcggttcaaatgaaagagattgaaaaaagatgaagtttgggctttgtggggagtgatttggataagaattgagtgagatatggctggaagaaaaattgggggcgagggttttcgagagaatgaaaagttgcaggtttcagaatttgaaatttgaataaataggtgcagggacgcatcgtaatcgattacacacaatatggtaatcgattaccagagagcaactttgccagaaataactgcttgtaatcgattacactattatggtaatcgattaccagtggttattttagccagaaaacaaaaatagaaggctttctaggagagaagaagttttgaaaactatttttgaaaatactatatttgaaaatactttatgactaattttcactcatgtaatttacatatcacgtcatgcaaaaatatttaaaacatgaagataatcaattttatcaagaacaattacaacacaagtatgaagaatattgattttacttaaataaatgaatgaatatttcatgcaaatagaatgaaatcaatcaagcaaatatactcatgatttcaatcaatcaaaagacaaacaaataaagaatttttagtcatcatagtcaatttgtttgaataaaaatttcaactttaagagaaattttaataagataatggttttgatattacctttttcagaattgaagagtctagatcttcaaagatgaggatcatgctttttatccttgagagaagttcttgtcactttcataatctttagttagaagattaatctccttttctgaaccatcagatgaatcattgtcatcccatgcaatgtatgctttcttagttcttctttcgtcaaatcttttcttttcacttttctccgaccattcttcatttgacggacagttggccttgatgtgaccaatttggttgcatttgtaacacctaaggacttgagaatcctcttgtgattttcttccattattgaaattctgacgcctatcaattcttcttttcttgatgtatttctgaaatttcttaacaaagaaggaaaaatcttcatcatcagaatcttcttcttcgttttcttcttgtattgaagatgaggctttaagggctatgcttctcttctttttgtcattttcttcattctgattgaggcgttgaagttccatctcgtgttcctgcaatttaccaaataaagtggcaagagacatggaagagagatctttgctttcagaaatagcagttaccttgggctgccattccctacttaaacatcttaagactttattaattaaatcctcattaggaaaaacttttcctaatgatgcaagatgatttacaatatgtgtaaaccttttttgtaaattctgaatgttttcatttggattcatcctaaataactcatattcatgggtaagagtatttattctagaactttttacatctgtggttccttcatgggttaactggagagtatcccacatatccttggcattagtacaatttgacactctaaagtactcatctatccctagggctgaagtgatgatatttttggctttgagatcgtactggatttttctcctatcttcttctgtccactgatctctaggtttttgggttgaagtacttgtgcttacatctactatagtgggtatatgtggtcctaattctattgcttcccatatatttagatctatggcttcaatgaatatttgcatgcgggttttccaataatggtaaccctcaccattgaaaatgggtggtctgtgaatagaatttccttcaggaaacaagggatttgaggaggccatcctacaagaaacctgctctgataccacttgttggatcgagtggcctcagaataattaagaagggggggggggttgaattaattattccaaaaactttaccaattaaaaattactcttttaaggcttttacttttgttgttaagagaatatggagtagaagagaaacttaacagaaagtaaaagcgaaaattaaatgcacagtggaaagtaaaagagtatggaagaaggaaacaaacacacaagagtttttatactggttcggcaacaacccgtgcctacctccagtccccaagcgacctgcggtccttgagatttctttcaaccttgtaaaaatccttttacaagcaaagatccacaagggatgtaccctcccttgttctctttgaaaccttagtggatgtaccctccactagaactgatccacaagagatgtaccctatcttgttctcagtcaaacccaagtagatgtaccctctacttgtaccacaaaggatgtaccctccaatgtgttaagacaaagatctcaggcttttaaacctttaatactttgtgaatggggatacaaaagaattctcaggcggttaaacctttgaacgcttttgtattagggaatgggaagaatcaaaagaattctcagactgtgtcgttttgaattctttgacaagggagaagggagacacaaaagaattcaagcggttagtcctttgttcttttggaaaagggagaagagagacacaaaaagaattcaggcggttagtccttggcaaatggcaaagggagaagagaatgaaaaggatgaatagcacaagttttcaaggtttagaaaaccagaaaacttcagaaagcttttggtacaaagaagaagaagaagttcaaagagattcaaagagattcaaggcttgtaaaggattgtatgaataattgttcaagattgttgttggaaagattgattcggaatgcaaaacaaagtcttgcttttataaactcttgatgtctggtcaagaaggccattcagaagagttataactttttagaaaaacttaaaacccatttgaaaaagtcaaaacctttttgaagagttacatctttagatttttaaaaaacaaacactggtaatcgattaccaaatatgtgtaatcgattacacaaagcttttgagtgaaacaatgtgactcttcacttttaaatttgaatttcaacgttcaaggacactggtaatcgattaccaaaacattgtaatcgattacagccttttgaaaatatttggaacgttgtaaattcagtttgaaaactttttcaaactcattttgctactggtaatcgattacaacaatatggtaatcgattaccagagagtaaaaactctttggtaaaggttttgtcaaaaactcatgtgttgttcaaagttttgaaaaactttttaatacttatcttgattgagtcctttctttattcttgaatcttgagtcttgaatcttgagtcttgaatcttgatcttgattcttgagatcttgaatcttgattcttgattgtaggctttcttcttgagtcttgaattcttcttgattcttgaactcttgacttgttcttgattcacttgagatgttctttgattcacttgagtttttctttgatcttttgaactttttgttcatcaccattgtcatcatcttttgttgtcatcattgttatcatcaaaacacctttgaatcattgttgattcatcatgaagctttgcttccacagatggtggtttaggcttgaaaaaaaagctttgtcaaaagtgttggtgtacaacaatctatgcacaaggatctcgttaaactcatctgggagataagaaatttgttttttcatgaaaattttcaaatatgttaacaattgttgatggttgattttaaagattaagatttttcacgaaattctttagatctgttctattacttgattcaattgaaaattgtttaattgtatcgtattattttattatatgatttttgttgttgtatttgttgtctttggatatgtaaatacatcttcattatatttctcaccggaaagagataaagatagaaaggctaaaaagaaaaaacaaataacaaaaaaatcttgattgttagattaaaaataaaataatctatttttaaaaaaaaggaagcgatcttggacggttgagataagagaaacttgcaaacacattgagtaatagatatatccaaaggccaaaaaatagttacacatgttgcaggacctatcggactttaccacactagaaggcgtcataacctatatcaaagtgtcgcaacctacccttcgacgggacggcgaggcgaaaagccaaagttgcgtcttctcatgaagaaagcgcgtagagtcgccaccaacgtttattcaaggaaaacattagaaaaaaccaaaaagaggtctgcggattttgaaaataagggttcgggagttgtttacacacggggaaggtattagcaccccacacgcccgtcacaagagacgacagcctttaatcgaatgtgcaaaaatgtgacttcaaaattatgtgaggactttgagtcctatgaaagataaaagtgaggactttgagtcttgtgaaagataaaagcgaggaatttcaatcctgggaaaaataaaggcaaggactttgagtcctctaaaagataaaggcgaggatcttaagtcctctaaaagataaaggtgaggactttgaatcctctaaaacaagccaataagcactagtaccaatgggctcaaccttaagagaaagcaagagatcgactttttgagagggcctctcatccttaacttaaaaaattagatttggtaaagtggtatataaagagaaatctacgcacttatagcctaatatgaacatgattttgggatgcagatgcatgcaaccttcatcttgaaatgctaataatgcaaaaggttttgaatcatgaaaattgtgtaatgctcatgacattctttcctatttttgtgattttgattttgatttgatttttttttttgtggaaaacacatattgactgtctctttctagaagacatgataattcatgcaaccttattttttttttttttgcaaatctcttcgatgactcccttagagtgtatgtttttgtttgatcacttgaaaattttggagtgacggcaatggagctgttttacatttaatcaatcaaccgaaacattgatcctagggtttgtccctttcttttttgtttaaaaccttctattgttctgcacagcaagaaaacataaggctttgggatcgattgtgcaccacactgaaggatggcaatgaattgtcacactttggtatgtgaccaagtgaaactttcctgatttaaggtcatagagtgatgccaagggtttgtcgattccactgaaacttgatgaaatgggctaatcccgaaagaatttataccacaaaggccaccctggattcaaaaggaattctaaggagtctgcatgagcaactaatatcagatgtaccctactatcacaattgtctttgggaattttccatgagctcctggtcgaatgagttttcttctcagatgtaccctactatcacaattgtctttgggaattttccatgagctcctggtcgaatgagttttcttctcaaatgtgcaagtacaaaacctcgaggattctttttgttttgtttatatatatatttttttaacaatcacaagcgtgtgtaggtttcattctagaatcccaacttaaaagaaaaattagtcattccttgatccacatgggctttactgggcttgtaacgtggtcaggggtaagaagactatgaaagaaaggatttagagaggcttaaagagtgtttaagggttacattgagtaagaacctcaagagcattgcttataccttttgggttgagctctactccttttgtcttatacagtaatctttattgcacttttgtgcctttcttgtaagatttggagatcttttgtctctttttttttcttcactcgcctttggcggactttatctctctttttttattattgtttcccaacttcatgcatgtgttgtttgcattgctcttcccaccagtttagcagtggttcctactcagagttcctattttgtttttgttgtttttcgaaaacaaatatgctttggttcggagagggtagcaagggataaattagtgtttgggatgttgaaacatggccatgtgtcatttcaaatcttgactagatacttttgtagtttggattttgagacaaaaccttaataacacgcccctaattgtttgttttttttcttttttattattaccctaacttttgcctaggtcaccctttcaggttctgaacctatcgggtaagaacttctgatctgcccctaagtttgcttgaggctcatgcatggtgcctctcattgccccaatgtagggctctgaggtatctattgttgccttttgtcatgaccttgtagcaaggaaaaaaagaaagaaactatgcaggttctcaaaaatgaattccgaaggatgagaaatgtttaaaggattttcaattgacagattaagtcgaacgactcttgttcttgataattcacttttctctcaaaaagaaaacttttaagaatgataaaataaggtcacatgaatgtttttacttcttattttttatttgaaacacgattaatcaaacgttttttttttactttactcgtcgtttacggcaccctcaccaaacgtgtagaacgagcaatttctgattgaacagacttggagatcaactcagaagtgcaggttgcttgagccaacaaaccaatggcttacattcacattccagtgaaagtaaaataagcaaagacgtaattgcgagagaatgagagacaaggacatcaaatttatccatattattagcattgtgactattgtttataataatgccataaacttaaaaatcctaatgagtcattggagacatctaacaacaaccttcaaattgccccatgcatagtgtagcttgacaacgttagaattcgtaagcgattgtcctcctcgaatttcaattagactttgcaccttacgtttcagggtcatacaatgctcaatggaattcccaggaactcctccatgataagcacattttgcattcaagttgtatcctcgggaaaatggaggttgaggaatctttgttgggattatgactaccattgcattattaagtagatatgggagcaaattagcatacgacacgggaattggggtgaattctacaggcttcttttctagaaaattccttccttggttagtgttttggtttgtgttaagggtggtgtttgatatcggatgtgcgacaggagggctttgcggctgatttaggggtggcctttgtggatgattgggtgttcttgactggtagggtggtgggcaatgagaaggactgatattggctgagtgttgacattgttaagttggcgagaaatttggccatgtagggacaacagtcatagcacgggttcttccctccttcttattctctccattttccccaagcttcatattcatccaagtaggataattaaattttcctcttcttagatccactttgatcctttcgctggcgaaaaccaaatcaacaaagcttgaaggcatgtaacccaccatcttctcatagtagaacatcggtaacatgtctactatcattgttatcatcttcctctccatcattgggggcgctacttgagttgccatatccctccacctttgggcgtattctttgaaagattcatgctccttcttgcacatgttctgtagctgcattctatccggagccatatcagaattgtattgatactgcctaatgaaggcaaccattaggtccttccaagaatggactcgggaaggttccaaattggtatactaggtgacgactatctcagtaagactttcctgaaagaaatgcatcaataatttttcatctttcgcgtatgccccccattttcctgcaatatatcttcaagtgattcttggggcaagtagtccccttgtacttatcgaaatctgacaccttgaacttcggagggatgacgacgttaggcactaggtacaactctgccatgttagcaaaagcatgatctccgcctccttcaatagccctcagtctttcctctctctgattgaatttttccctttccaccatagcaggagggactcttcccaccgcaaaatgcaagggttgtggttgtgggaaaaactaagggcccccaaagtgtttggcaggggtacaccactaactgcttgcccttcagtggcatatcggaggtgaggttcgaagtcgattatattatggtctcggggtgcttcatgtgtctcctccatgggttgagagacatgtgcatgatcagattggggtttttggctctcaatgggtatgggggcatgaagttgtcgacattctcatcgtgagtgtgtgcaacattgggtggtgcgtagttgggaggcaagccagggaatgaatgcttgctctaaacttgcacaaaatggtgactggaggatttacttgattgaggctcgataagtaagtcaggtctacctcagtggtgacactcgtagtggcaactgcaaccgcattgctttccattattttcttcatgctcaacatggcctccatcatggcggccatttggtctttcatggcctccatgtcggccttcatctgttcttgcacttcttctatttcactcattattctagctcaggcacgcgttcggtaagggcgccataaaagtgcattctttccttttgattacaatgattacagttttgatttcaaggaaataatgaaatgagcaatgcaaccaacgtgaaaagaaaaaataagcatggatgtatgtgaacaaatacattgttgaagtattgcaaatttacatagggcactcaatagggtcgaaccaatttagattttcattaaaacaacattgttcattacattttgtcaaaatgcaataggaaataacgcatggacatcaacaatccctaatttttgttaattatttagctcaaccatgtgttggcagtagacaaagaagctatgtaaacttgatccatcttctgccccaacttttgcaagctagttatttccatacttgactttgacttgatgaaacctttttcttaaaagcatgtgcttggttcgaccccataatccaaggaatagaaattttgactgtcaatacttcaacaacatatcatagagatgaatgacttgggcatacttatgctatgcatgacacatgtaattatgaggttgacatgagatgcttgaagaaacatcatttccaagttaaccatgcattaggtaccatgttcacatgattttcaataattttttaagagaaatgagtgcataatcccaacatggttggtttatagctatcatcatagtacccaacacatgtaactaagaatgtggtgtaaactttcacactttatggtgactttcttttgttctttctttctttatttttaatttttttttttttgcagaggaaaatgcaaggatcatgcatgcaaactatgaaaatagaatgtatgcagttggcagaacaaaagcatgctaaatgaaaatgcatgacaatgcaacaacttatgcaaatgcaatgcatggatatgacaaatgataaatgcaagaatgatatgtacattatgatgccatgaagagatgcatgatgcgatcaaagaacaagccagagtgagttttctatgtgccaccctaatttaggaacctaatggaaaggatccaaaagtccccttctagtcacaacttccaaggatggtttcatgtaactttaccggtctctagagatatcatcctgttagataatacattgtggcgatagggactatcagcgacaatgcatcaccaaaagaggaaaactctagataaggcttcactgttaccaagcgagtcagagacccagcatgaacacagattgacctccactccttatggctcacatagacccgggtatagggcctaatatctcaacgtgtgtgcgaggcgtaggtgccatgtgtgcgtagaaaaaaatatttctaactatgaatgtaattgatagacaaacacacaccaaacacaacaacatagcaaagattatatacaaatatggacaaaacaaaagataaaagggaaaagggaacataaataaagaagaagtcacgataaaaacattgcacactggctgaatgacctaactctctaacagtccccagtggaattgccaactgtcacaaccaaccctttggcgaaagggcgaggcgaaaagccaaaggtgcgtcttctcatgaagaaaacacgtgaagtcgccaccaacatttattcgaggaaaacgttagaaaaaaccaaaaagaggtatacggattttgaaaatatgggttcgggagttgtttacgcacgaggaaggtattagcaccccacgcatccgtcacaagggacggcagcctttaatcgaatgtgcaaaaatgtgacttcaaaattatgtattttccctttttatattttttattttttggggtcgacaagggtgttgcccttgcttctacgtatcctcaggtgcgatgaggaatttaaacctacatagttctttaagtctgaaagtttgtgtgttacattaattttatgctttttaaaagatcgattttaattgcgaacaaaagtcgtttaaggcattggaccttgaaacgatgttttaaaaatttgaaaagcggagagaatggttaaggcgttggaccttgaaacgacctcaagtgatgtttgatgaaaagcagagagaatcgttaaggcattggaccttgaaacgatctcaagcgatatttgattaaatgaagaagtttatgagttggttttattttggttttgcttattaaccttcaatcttttttaaagataacttgtaagggtgcacaaaacaagaaagaggatgaagatgagattattgatgataaaagaaggagatgaagatgcacaaaacaagaaagaggactcgtaagggtgcgtagatcgcattcaaatccttaaaacaaaaactaaccggatgacaaacgaataacaaacgaagaacaatgtagaagtcgattaggatcgcaattcggtagcacctcggcctcgtttttctcttctttcttcttcttctctctgatttctctcaatgttggaccttggaaccctttactcagcctccctcacacctatttatagcaaaagatggcattaggagtcatggcagctcacccaggcgagttatagcttcaacctgaagtaactttgcttgcccaggcgagctagttatttcacccctaagctattttggggcctaagcgagccaggggctagcctgggttcagaaaaaggcttaaaatgaccctgttgccctctttttttgggtattttctgtattccttatggaaacatcaaatgatctttcatcttgcacggtaactggtgtcatacagcttaattcggctagcgaggatcaaaagatcaacaaatgatagtcttagaacgaaattagggtatgacacaaagttattaaactaacactcgtagtctttattgtctaagcctttctacgccccaggaatctggtgggactaaagcgcttaagattaacaatgttggaatgtccatcaataacaagctcagcaacaactccagtggcaggaccattaagaatattatcccaattatgccctgttgcaacataacaccccttcacccctggaacctctcctattactctcccttcacacatgccactccttccctaagatggcttgaaacagtcttcaccacctttttaagcatcacaattaattcagggtttccctttatctcctcacgattatccgaaacttctttctccttcgacatcccacatatataaacctcccctgaaaataaatgtttacattattaacctctttattaatattattattactaagtgtgactaattactacacctgggaatcaacaagttgcgtttgtccgaatgatactagattctgtttggaagggaagaactcattaaaagtgaccagttaaattctctaataaaaattaatgattggtaaagtcggtagatgttctgtaaaaaaataaaattaacatacctgtgtggggagggtacacttcggggtcaagagattttcctcgtttagaagaatagtaactgagaaagagggcatgcagggttatagaaccgggctctctggcctctaatacaatgctatgggccttaagcccataagcccataaactatgaacaacaaaaccaacttactggactaagggcccaatgttaacaccatagaatccgcttccaaaactcgtccttcttcaagcaccatcgatccaactcatccttcttccacttccaaccgttcctattttgtaatctctatcttcactccatgcttctccactgatctatcaatcagcgcgggaatgaagagccataggtgcacctgcactgtcatttcgatggttccaaccacgagtaggtctgtcaactcaagacgacaacattgaggtggcagaaaaggagccttcaaattccgtaacgatgaggctgagagtggtgagggttctgtaactgtacgatcatgaaccgtctagttcttcgaagagtgaacggtggaggttgaagctcatgtgagctagctcttctagcggtcctctattgcaccaattgagggcaaggaatctgccagctttttcgaatgcagtgcatgccacgttgaatttctcaatgagcatgatatagacacccttcaccgccagaaagtaggcggtgcagacttcgatgactccatcgccgcaaacaaccacttgcttcgaatgatccatggacagtgaatcaatcaactttgctgtcaagatgtgaattctgttttgccaaaatgcaattagtggtggccacaccccaccacttgattcattattcatactcatccaaaatcttttttcttttattttttatttttaatcaagcacatgtttgttagtatgtttgttcacgttccgacattggcaaaaacttctactatttgatggactatttgggcccttctgataaaagaagtgcatatccaatattagcgaactactataggcaccacctactttttctaatggcactaaccgtgagggtgctttttgtccatatttcaaaactgtccccttaaaaattacataatagaaacgtgcttccattgtgcaattggggtgaaaaaaatgtacaacaaaagtacactttctttgtgtatttttccccctaattgcataacaaaaacatgttttcgttgcacatggatagttacacaatggaaatgtgttttctttgtctagacatacaacaaaaatgtgtttttgttttgttagaaagcataaaaaattacacaatgaaaacatgtttcatttgcacatgggtagtgtcgcaacctacccttcggcgggagggcgacgcggggctcacaggtgcgtttttcaagaaaggaaaatgcacggagttgccaccaacatttatttgaggaaaacatcggaaaaaccgaaaaaggtgtggtctacgaactttaatcgtgaaaggttcgagagttgtttttatgcacggggaaggtattagcaccccacgcgtccgtcacaagggacgacaacctttaaccaagtgtgcaatatcatgtcttcgatttgttttattttccctttttatgtttttatgtcttttttatgctttttgtattttttttatctttttgtggtcgacaagggtgtttccctcgctcctacgtatcctcaattgcgatgaggaaatcagacctacgtagttctttagaactaaacgttggttaagttgtttttatcttttttcgcaagatatattttaaccgaacaaaaggtcatttaaggcgttggaccattaaacgatcttttgattttgaaaggagagaaacgttaaggcattggaccattaacgatctcttggtttttgaaaggagagaaacgttaaggcgttgaaccattaacgatctcttggttttgaaaggagagaaacgttaagacgttggaccattaacgatctcttggggtggtcaacaaaagcggggcttttgctcctacgtatcctcaattgcgatgaggaaatcagacctacgtagttcttgcaaaagcggtaaagttatgtgttgattttatgctttagaacggtccatgttaaccgataaaagcaaagatgatcgtttaaggcgttggaccttaaaacggttttgagtgacttttgcggacgaagcttgatttgtgagttgattttagccttaatttcactttgattattagtcaattcattcaaggaaacttccaaagaaaaacatccgattgatttttttgattattttattcaaagatattttgattattttattattatttttccctttttttgtctaaccgtggttacagtgtgaacgattgattagattttactttaatggtgattaatcgagattacaactcaaatgatcggttgaaatttattttatcatttactatgtgagaaaacggattaaataaacggttaaagcacgataaaagggggtacggaaaacaaacgaaatgaaaataaaagtacgcgaaacaagtagggaccactaagggtgcatagaatgaattgagagattcaatttcgggaacttatcgaatgaagaccgaagaacgatgaagaacgaacgaagaacgatgaagaacggtgaagaatctccacgaaatcgcctacggaaacgtctcggaagtgttacggaagcacctcggcttggatttttttcatggaacaatttttctcactaatttcgagagaattctcaaatactagaagggctgaaccttttgttttgccctctttccccaatttataggagaaaaaagggaggtggttgccgcccagctcacccaggcgagcagggttgtttccactagaaggcaccaccttcttttggaactctcaggaaggcccaagtgggcatggttgctatttgcaccccctttttcactaaacacactcccttttgtgtttttttattgattcctttccgaaacgttacggaactttacggattacgtaacaacacccattttcattttggaatgttgcgaaaccttacggattacgcaatgatgcttgtttttttccttccggaatgttgcggaactttacggattgcacagcaatacttgttttgacttccagaatgttgcaaaactttacggattgtgcaacaatacttgttttgacttccaaaatgttgcgagactttacggattacacaacgatgggtgttaaacattttgaggcggtcaagagaaggtcgcatgccaacaaataatggtccctggacgaaattagggtatgacagttgcccctctttacttatcttttattggagataaaagcgaagtaaagataagacactaatttcgttcgagcagaacatcattcggccgatcaatatcccaaccagcggaacctgtcatttagaaagaaaagaaaaggcaccagaagcgttagcaaaacttcagtgtcttgaaagcgataaaacaggataaccatgacgtttccacatgctatcgaactcgatcgtccctgcctagcagtgaagaatcttgcgcgtcgtcggacttgaatgtctctggatgacgaaagtaaaacctgcaaaaattttcaaaaataatcagaaccggacgaccacatcatcccgataccatcgaactcgttcaccttggttgacgaaaggtgcggataaccataaggtacccccgcatgtcatcggattcgccgtctttggatgacaaaagtaaaaacctgcaaaaatttcaaaaaataatcagaatcggacaaccaacatcatcccgataccatcgaactcgttcgccttggtggacgaaaggtgcggataaccataaggtacccccgcatgtcatcggactcgctgtctctggatgacaaaaagtgcagaagacgatgttagtctatgcgtgtcaacgggctcgcttgcctctggttgacaaaaggtacagaagacgacgttagtctctgcgtgtcaacgggctcgcttgcccctggttgacgaaaggtacggaacacaacgttagtctctgtgcgtcaacggactcgtttgcccctggttgacaaaaggtgcggataaccatacggtacctccgcatgtcatcggactcgccatcaatggatgacaaaaggtgtggataaccatacagtacccccgcatgttatcggactcgctgtctctggatgacaaaaggtgcggataaccatacggtacccccgcatgtcatcggactcaccatctctggatgataaaaggtgcagaagacgacgttagtctctgcgcatcaacgggctcgcctcccccctggctgacgaaaggtgcaaaagacgacgttagtctctgcgcgtcaatgggctcgtttgcccctggttgacgaaaggtgtagataaccatacggtacccctgcgtgtcatcggacttgccgtctgtggatgacaaaaggtgcggataaccatacggtacccccgcatgtcatcagactagccgtctctggatgaaaaaaggtgcggataaccatacgataccctcgcatgtcattggactcgctatctctggttgacaaaaggtgcagaagacgacgttagtctctgcgcgtcaacgggctcgtttgcccctggttgacgacaggtgctgataaccatacggataatcgcttgggtatctccacatgtcaccggactcgccgtctctggatgacaaaaggtgcagaagatgacgttagtctctgcgcgtcaacagactcattcgcccctggttgacgaaaggtgcggataaccatacagtacccccgcctgccacctgacttcccgggtcagggttaacagaaatcgtttgtacgaataaccgcttgggtatcttcgcatgtcaccagactcgccgtctctcgatgacaaaaggtgcagaagacgacgttagtctctacgtgtcaacgggctcggttgcccctggttgacaaaaggtgcagaagaagatgttagtctctgcatgctaccggactctgagtctgacggatagcaaatgaatgtgtgcgggttaccgtatagggcatctccgcgcaccaacggactcacaggtcacgatagcaaaaggttgggcggtcgacaaaagcgaggcttttgctcctacgtatcctcaatcacgatgaggaattcagaccaacatagttcttgcttttgtgatactaaaatagtctcggtgttttttcactaaaatgcaaacaggctttagtaaagaaacaaaacctccaactgatcagagcaacatatgatttttgatgaaaaacaatgtgtctaatggggaaggagagtatgctaatgaaattttctcataaccataaatgagattttggatgttagcattttgtttctaaacgaccatttagaggaaacactgggtccaacaaaaatagaagaaaatcactcaaagtgtatcaatctcacacaggtaagtgtttcatcctaattcagaaccatagatatgtcatgacttgattttgcaaatcatttcctatcaaatcaaagattacatgtgtgatcacagatcaataggactttttcgggaatggtgtttttttttttgtgggaaatttggctctgagtgttttggccttttccttttctgtttttgtttagtgcggggcgaaaaagtcaccgacgcacaggattttggttggcaatcaaacggagaggaccacttcaagtcgtggtttcctttctttccttatttggctgtgactattccgtattgtttggatatttgtcttgtccgaagacacttctgtataattctttcattgtctttgatcggagattttctcctttttttttctctttgttttctcacaatctttgatcaggaatttctttttttcttttgttttctttcgatctttgatcgggaactttctttgttatggaagcatgttagcaactcaatagtgaatgactttttttcttgggagaccctattgctccttcttctgaggacagggatggaaattctcatcctgggtcaaggtttatggtggtttgaggtcttgggtcaaaaggcttgtagaacggccggacatgatgtatgtcagggtgttggtttggccagcggttcagggataaaggaatgtctcacattatttccatgacacacatgcaacaatgatgatttagaaattttatgcaaaactggtcatatatgcacccatgtggacactcaagtatcaagtttttatggtcatgtgacactagggcccaggattcattttccctatttaagtcaacctagtgtttccaaaacatgttttttttatcaattcatgcatccattcgagtccattttgggcgttcagaaaaatttcacagcattcacccttcaggtgtagacacattttcctcaaaaacccttgtgttttgattggtgactctttccaaagaaaagctggagactatttcttttcaaaagcatgttggctttttagttaaccaattattattattattttgtttttttgtttttgtttgttttttcatgaggtattttgctacctaaacatatgtatatttttgtgaggtatttttgctatatacatatgtatccaaggtatcttgctacctaaacatacatatatatatattttgtgaggtatttttgctatatacatgcatatccaaggtatcttgctacctaaacatagatatatatatatattgtgaggtatttttttgctacctaaattacatacatgtatatctaaggtattttcgctacctaaacacacatacatatattttgtgaggtatgactaccttccgagcttgtgcttgttttatttaaattcctaggatcatgagcaactaggtgtgtcctactatgacttgagaaacaaaggtgatcaaataacaagcagagatttaaaaagtactaggttgcctcctagtagcgcttctttaacgtcttgagctggacgtgtgatgacttgtcgatcacagacctagtacttttgcttacctttggctttggaattggtcgcctgctggtcggtcatgggtcgtaggcaacgctccagcctttgtagatgagttgaggggctctggaggtggtggcggtgtatctattgcccgctgccgtccatccctaggctgctgtggtgtctcgccctgcgcctgcctgggggcgcaatacttcttgatgaaagcttggttaatatggggcctgatgaccttgttgggggcgacgggcactccgtagaattgacaaaggcccataatcagagctggaaacctcaggaccctgttggacttctccgggtccactggtgtcttgcaggcgcgatccctgcaaatattggatgacatcagaaatcaattgagagatgtgcatagttacctatgtcacgatggggtgaccttactgggggggacggacaccctgtaggactgacagaggcccgtaaccaaagctggaaaccccagggccctgttggactccttcgggtccattgggtgtcttgtgggcacgatccctgcaaataggggatggcatcagaaatcagttgaaccacgtgcatacttacctatgttacgatggcatgagcttgctgggggggacgggtaccctgtaggactggcagaggcccgtaaccagagctgaaaaccccagggccctgttggactccttcgggtccactgggtgtcttgtgggtgcgatcccaactgatacttccatagggggagttcgacattgtggtcactgggcagaatgttgctaagtagcaacgtcattcatatctgtgtaagagtggtcatgttggtgcgcatgatctgcactcgtctctttgcagtggcacgggagaaatcttgccccggtatgcacagtagctgcgcgatagcctcctcctctggttgtgctcgcatagttggccctcctccaggatcaaggggtggcccaggagctgataaaaggaaactactggccccttaaccgggagcgcaagtctcggttaagcattaagggcagaggaccttaaattctctaaaggtgcggatgtggagcccactgaaagtgaggacacatcgccctctaaaggcgagggcgtgcagccctttgaaggcgaggatgtgtagtactctgaaggcgaggatgtgtagtcctctctaggtgaaggcatgtagccctctgaagacgagggcgtgtagtcctctgaaggcgagggcgtgtagccctctaaagacgaggacgtgcagtcctctgaaggcaaggacatgtagtcctgtgaaggcgaggacgtgtagtcctgtgaaggcgaggacatgtagtcctctgaaaggtaaggacatgtagtcctttgaaggcaagggcgtgcagccctctgaaggcgagggcgtgtagtcctctgaaggcgagggcgtgcagtcctctgaaggcgaggacgtgcagtcctctgaaggcgagggcgtgcagtcctctgaaggcgaggacgtgtagtcctctgaaggcgagggcgtgaagccctctaaaggcgaggacttgtagccctctcaaggcgagggcgtgcagccttctcaaggcgaggacgcgtagtcctctaaaggcgagggcgtgtagcactctaaagacgaggacgtgcagtcctctgaaggcgaggacgtgctatcctctgaaggcgaggacatgtagtcctctcaaggcgagggcatgtagccttctaaaggtatggacacgtagtcctttgaaggcgagggcgtgcaaccctctgaaggtgaggatgtgtagtcctctgaaggcgagggcgttcagccctctaaaggcgaggacgtgtagttctctgaaggcgagggcgtgcagccctctgaaggcgaggacgtgtagtcctctgaaggcgagggcgtgaagccctctgaaggcgaggacttgcagccctctaaaggcgagggcgtgcagccctctcaaggcgaggacgtgtagtcctctcaaggcgaggacatgtagccctctcaaggcgagggcatgtagccctctaaaggtaaggacatgtagtcctctgaaggcgagggcgtgcaaccctctaaaggtgaggacttgcagtcctctcatggcgagggcatgcaaccctctcaaggcgaggatgtgtagtcctctgaaggcgagggcgtgcagccctctaaaggcgaggacgtgtagtcctctgaaggcgagggtgtgcagccctctgaaggcgaggacatgcagtcctctgaaggcgaaggcgtgaagccctatgaaggagaggacttgcagccctctcaaggcgaggatgtgtagtcctctgaaggcgaggacgtgcagtcctctgaaggcgagggcgtgcagtcctctgaaggcgagggcgtgcagtcctctgaaggcgaggacgtgcagtcctctgaaggcgaggacgtgcagtcctctgaaggcgaggacgtgcagtcctctgaaggcgagggcgtgcagtcctctgaaggcgaggacgggtagccctctcaaggtgaggacgtgtagtcctctcaaggcaagggcatgtagccctctcaaggcgagggcatgtagccctttaaaggtaaggacatgtagtcctctgaaggcgaggacgtgcaaccctctgaaggtgaggacttgcagtcctctcatggcgagggcgtgcaaccctctcaagacgaggatgtgtagtcctctgaaggcaaggacgtgtagtcctctgaaggcgaggacttgtagtcctctgaaggcgagggcgtgtagccctctgaaagtgagggcgtgtagccctctgaaggcgaggacgtgtagtccgctaaaggcaataggttctagtaccgaagggtccacccctatgagaaagcaaaagattgactcatcgagagagcctttcatcccaaattaaaagttgggacattagatgttggaaatctatgtagttaacatgatttttagggatgcagatgcatgcaacctttgtcttgaaatgcggacttcgtaaccatcattgccccagtgtagggctttgaggtaaccatcattgttttgtttccacaaccttgtagcaaggaagaatgaaagaagcagttgattcttgcaaaaagaattttccaaggacaagaaatagtcaaaggatttttcagttgacggattaagtcaaatgactcctattcttgataactcacttatctctaaaaaagacaaactttccggaatgataaaatgagtcacatgaatgtctatattttacttgaaaacacagtcaatcaaatgcttttttccttttcttttttccttttctactttactcgttgtttacggcatcctcaccaaatgtgtagcacgagtaatttctaattgaacggtcttggaagtccaaactcaggagtgcatgtcgcttgagcaaacaaaccaatggcttgcacccacattccagtggaagcaaagatgtaattacgagaggatgagggacaaagatgtcaaatttattcattttatttagcattgtaactgtggtttacaataatggcataaacttgaaaatcctgatgagtcattagagacatctaacaaaagctttcaaatatcttataaagtttttaagtaaatattacatcttgaaaattatgtatttctctctggtaaccgattactagaggctgtaatcgattaccaaaagaaaaaatgttttttaaacaactttcagaaaagtttaaatttgaattttaaaatctataatcgattatcactattgtgtaatcgattaccagtcacaaaaggttttgaaattcaaactgaaaagtcatgactccacaaaattaactgtgtaatcgattaccacatatctgtaatcgattaccagtgaggaaatttcagaaataactctaaaaattcacaactcttcataaatttttttgaaaggtcaccaaaggcctataaatatgtgacttgtgttcgaaattcttcagagtttttcaaaacattcattgtcctatcctctcacaagaaaacctttagccaaacacttgcaaaatcattaaggattcttataagttcttcaagttgtatcattcttctcttaaagagagaaaaacatcttatgtacttcaaaagcaatctgttgttgtaatcaagaggtagtgggtctcttgatttgtaagttctctgaacacaagggaaggatatcccaaggtggttcagaagttgtaaaggaatttacaagtatagtggaaatctcaagtgaattacttgaggactggacgtaggcacaggacatggccgaaccagtataaaactgagtttgcaattctctcttccctaaactcttttactttattgcaatttatatttactttgcatattcaaagaagcatcaagtaaattgtttattacttcttttttctgcatattaagtctacatatttcttttaaagagagaattaaaacttgttaggagaaattttttaaacttaattcaccccccccccccccctcttaagttattgagtttacttgtgtaacaagtggtatcagagcttaattcttgtataaggtttagaaacttcaagaatagttatggcctcatcaaattttttatttcccgaagagaactctataaataggcctcctatattcaatgttgtgggttatcattactggaaaacccgaatgcaaattttcatagaggctatagatttaaacatctgggaagccatagaaattagtccttacatccctactatggtagcaggaaatgcaactatagaaaaacctagggaacaatgggatgaataggaaagaaaaatggtacaatataatttaaaagccaaaaatataattacatctgcattaggcattggatgaatattttagagtatcaaacttcaagaatgcgaaagaaatgtgggataccttacaagtaacccatgaaggaacaacatatgtaaaaaggtctagaataaataccctaacccatgaatatgaattgtttagaatgaatcaaaatgaaactatacaggatatgtaaaagagattcacacacatagtaaatcatcttgcatcattaggaaagatatttcccaataaggatcttattaacaaagttctaagatgtttaagcaggaaatggcaaccaaaggtaatggctattacagaatcaagagatcttattaacatgtctcttgcaactttgtttggaaaacttcaggaacacgaaatggaactcatgagactaaatcaacatgaggaaaatggcaagaaaaagaaaggaattgcacttaaagcttcatcttcaattcaagaaggaggtgataaagaagatttgaatgaaatagaggaagatgaggattttagtttcttcgtaaagaggttcaataaatttttaagaaacaaaggaaataaaaaaagatcaaatttcaaaccaaaaaaaaagaggagaagattcaccctctcttccaaagtgttatgaatgtaatcaacgaggacatctgagagttgatttcccaagtttcaagaaaagaatagaaagatctgaaaagaaaaccttcaatgataagaaagcaaagaaggcttacatcacttgggaagacaacgatatggattcatccaaagactcaaaaaatgaagttgtgaatctaagtctgatggtaaaaaattatgaaagcgatgaagaggtaacatcttctaacaataacttatctatttcctttgatgaacttcaagatgcattcattgatttacataaaaaatcagtcaaacttgcaaaactagtttcattttctaagaaaactatttcaaaattagaaaaggaagttttaaaattaaatgaagaattagaaaatcttagaactgaagtcaaaactttaaaaccaattggcacaaatcaatcttccaccataaaagtaataaatgatagtaaaaaagcatgtaattgttgtagcaagtttatagaagaaatcaaggatctaaaaaattctctttccaaatttattgttggcaaaaataatctagatattatattaggaaagcaaagatgtgtgtttgatgaggctagattaggatatagacctgataaacaacaaaagttatataaaaaattctttgcatccaatcaaaagaatagttctcctttcttaacttgtttttactgtagaaagaaaggacatggtgcatctacatgctattttaggaaaaataataataatattaaaatgatatgggttccaaaaggatgtttttatcaaaactaacattcaaggatccaagaaagcttgggtacctaagtcataaacatgatcatataggtttctttgaagaagagttggtacatagatagtggatgctctaaacacatgacgggagatgcatcaaagttcactcatatttctcccaagaatagtggacatgagacttatggcgacaacaataaaggtagaatccttggagtcggaaaaataggtatgaattcatctacctccattgaaaatgttatacttgttgatggtcttaagcacagtttactaagtgttaatcaattatgtgataaaggctatctagtatcatttgaatctcataactgtgttgttgaaaacaaacatgatagaaatataaaacatataggctatagattaaataatgtttacatgataaatttaaataaaacattaaatcatgatcaatgttttcttagtaaagatgataatccttggttatggcatagaagaattgcccatataaacatggaacatttaaataaactaatttctaaggatttagttattggtttaccaaaacttaaatttgaaaaagatagattatgtgacgcttgtgaaaaaggaaaacaagtaagggtttccttcaaatcaaagaatattgtgtctacaactcaaccattacaacttttgcatatggatctttttggcccctctagaactatgagttttggaggaaactactatgctcttgttatagttgatgattaatcaagatttacatggacattatttctcactcataaaagaggtgtttttcatgctttcaagaaacttgctaaaattattcaaaataagaaaaatctcaaaattgtatctattaggagtaatcatggaggataatttgaaaataaggattttgaatcattttgtgatgaaaatggcattggacacaatttttctgcacctagaaccccttaacaaaatggagtagttgagaggaaaaatagatctttagaagaaatagtcagaactttgcttaatgatgcaatccttcctaaatatttttgggctgaagttgtaaatactgcatgctatataatgaatagagctttaattagaccaatcttaaagaaaactccatatgaattatataacagaagaaaattgaacatttctcatcttcatgtgtttggatgtaaatgttttgtgctaaacaacgacaaagagaacttaggtaagtttgatgcaaaatttgatgaaggtatattccttggctattccttgcacagtaaaacatttagaatttataacaaaataactatgatcattggataatctatccatgttgcttttgatgaaactaactcaactgtgcctagaaaggatactctagatgatttttcagattctttagaaggtatgcatattcatggtgaagagcacaaaggaaaaggaaagggaaatgatgaaaaatttcaaattgatgaaacaaaaacaagtacaaatcttctaagagagtgaagaacttctagataccatccgcttgacaacataatcggtgacatatctaaaggggtaacaactagacactctctcaaagatgtttgcaataatatggcttttgtttctttgattgaacctaaaaatttaaaagaagccataattgatgaacactggatcatagctatgcaagaagagttaaatcagtttgaaagaaataaagtttgggaattagttgagaaacctgataatcatccagttataggaactaaatggctattcataaacaaattagatgaacatggaataataattaaaaataaggctaggctagtagccaaaggatataatcaagaagaaagaatagattatgaggaaacatatgctccagtagctagattaaaagtcattagaatgttattagcctttgcatccataatggacttcaaactttggatgtgaaaagtgcctttttaaatggtattatccaagaagaagtatatgtggatcaacctcctggctttgaaaactcagaaaagcctaatcatgtctttaaactgaaaaaggctttatatggtttaagcccctagggcttagtatgaacgtctgagtaaattccttttagaaaagggtttttcaagagctaaggttgatactaccctttttattaaaagaaaattgaattatatactcttagtacagatctatgttgatgatatcatttttgggtcaactaatgattctctttgcaaataattctcgcaagatatgcaaaatgaatttgaaatgtcaatgatgggcgagttaaacttttttcttggactacaaatcaagcaaacaaagaatggaatatttattagtcaatcaaaatattgcaaagacctgattcactgatttgggatggaaaatgctaaacacatgactactccaatgagtactgcttgctatctggatatagatgaaatcagtcagtcaatagacataaataaatataaaggtatgatcggatctcttctttatttatctacaagtagacctgatataatgtttagtgtttgtatgtgtgcaagatttcaagcaaatcccaaagaatctcaccttagtgcaattaagagaatcatgagatatctattaggcactattaatctagggttatggtatcctaaaaattctacttataatctaataggatactctgattctgactttgtcagatgcaaaactgatagaaagagcactagtggaacttgtcatttcattggctctactctagtttcatggcatagtaaaaaacataatagtgttgctttatccactgctgacgtggaatatatttcttctggcagtcgttgtgcacaaatactttggatgaaacaacaactttctgactatggattaattcttgatcatattcctatttgatgtgatagtacgagtgcaataaacctatctaaaaatcctattctgcactcgagaaccaagcatattgagattaggcatcatttcttgagagatcatgttcaaaaaggggattgtgtactagaattcgttgacacaaagaatcagttagctgatatctttacaaaacctctccccaaagaaacattctttgttattaaaagagaattaggactcctagatatcaatgacttagataaatagttaatttgtttgtttattattttttcttttggttgttaacttttgattgtccttgctgattgtgtttgcttttgatatttattgttgattaaggtttaatgattatttttgcttgagtttttgagtgtctttgatgattatgtttaatagttatggtgattgttgatttgttgttgatgattatttttgaaattttgattgtctttgatgaatgtgtttgagagtttttatgcttattttgattattttgattgttgattgttgttgatgattgttatactgagtgtgtaagttttttgagtgaaaaatagttagttttaatgaaaaatctatgtttttagggtctggtaatcgattaccactccctgtaattgattaccatagaacatgaccctataatcaattacaatagactgtaatcgattactagagggtttggtcagatataggttacgcttgtaattgattatcatgggctataatcaattacagctcgtccctgtctataaatactgcatttttctctctccttgtgcaaccctcttctccctcactctccttgacggcgccccttcctctcaaaacttcaaatcaccataactttctcgtttcttgtccaaatcacttcaaacaaagctcaaatttcttctttttcaattctctacaaactccactgatcataattttcttaagaaagctcaaattgcaaaacccgcaaagaagagaaaggactcatcctccaccaccaccactgcaggccaacactgccacggcacatccggtgacccactagcaccaaaacccccttctttttcatctcccaagtcattgactctattttcttccaatgaccaacttcaaaggtactattcccaattctccaattgtgccattctcgatcctaagtatttagatgtagaattctttgatggggaaacctttgattgctatcaagtgtttcaaaattctgaattagttgagtttatgtctctaaaattaccatattatcctgaattagttagagtcttttacaataatcttaaaattcaggatgaagtcattttttctgaggtgcatcaaatacctattgttgttgatcaatctctattttattctctgactaaactgagcagtcagggtgttccttttgaaggcactctagttgatgattggaagcatgtttattctagtcatgatgctcgtaaaatggtctgtaatgaccatactgatatgaccggtagattgcttgctagctcattcacctttgagtgtcgcatcatgcattatatccttttttgagtcttgcttccccggttcaccaatcttgctcaagcctttaaggaggatttaatcttgctatgggctcttcaaatcggtcgccaaatggattgggcccatcttgttaggtaccaaatgcataaggcattacgagtcaatgcacctcttccatatcctcatcttgtcactttgtttcttcagcatttcaatgttcttttagaggatgaaccttttgttaaggttaaaagatcctttgctattggtgttggtgctattacctccttcggataccagaaggatatggatggccaatgggtgtataaactgtagaagcaagcttcatgatgatgaatcaagttgattcaagatgttttgatgataacaaaagatgatgacaaaaagcccaagagaatgatttcaagattgagtcaacaattcaagaatcaagagaagtttgatttcaagattcaagagaagatgaattcaagattcaagagaagaaatcaagaagacttcacaagggaagtattgaaaagatttttcaaaaaaacaaacatagcacagttttgtttttcaaaagaatttttctcaaattttctaagttaccagagtttttactctctggtaatcgattaccaatttcctgtaatcgattaccagtggcaaagtttgatttcaaaatttttcaactaaatttgcaacgttccaattgatttcagaatggtgcaatcgattacaagattttggtaatcgattaccaatgcatctgaatgttggaattcaaattcaattgtgaagagtcacatcctttcataaaatgctttgtgtaatcgattataaggatttggtaatcgattaccagtgacaagttttgaacaaaaatcaaaagatgtaactctttcaatggttttcagatttttctaaaggttatactctttcaatggttttcctgaccagacttcaagagtctataaaagcaagaccttgatttgcatttgaaataatactgacaacctttacaaacaacttttccacatattcttttacaacctttgaatttctttgaacattttcttgaacttcttcttcttcttcttcctttccaaaagctttctaaagttttctggtttttccaaaccttgaaaatagaagtgtgctatatcttttattctcttctccctttgccaaaaagaattcgacaaggactaaccgcctgaattctttttgggtctctcttctcccttttccaaaagaacgaaggactaaccgcctgaattcttttgtgtctcccttctcccttgtcaaagaattcaaaacgacatagtctgagaattttttttattcttccttttcccttaaacaaaagaattcaaaggactaaccgcctgagatatcttttgtttccccttcacaaagtttcaaagaactaaccgcctgagaactttgtcttaacacattggagggtacatcctttgtggtacaagtagagggtacatctacttgggttgttgtaactgagaataagagagggtacatctcctgtggatcagttcaagtggagggtacatccacttggttgttcaaagagaacaagggagggtacatcccttgtggatctttgcttgtaaaggattttacaaggttgaaaagaaatttcaaggaccgtaggtcgcttggggactggatgtaggcacgggttgttaccgaaccagtataaattcttgtgtttgtcttcttcttccctgcactctttaatttccattgtgcactttaattatcacttttacttttggttaagtttctatttttgttctttactttcttaacattatagtaaaagcctaatcgaatctagtaatattaagaaggatagatttttaattagtaaaggttcactaataattaattcaacccccccccttcttaattattccgagaccacttgatccaacataaacaagacctgccacctcccattctcgatgaacgcacaccctctctaccaccgcaacaagatacctcctcttccttattgaatgacgtcctaattgagttacaggtgttagatcaagtggcctcataataattaagaaggggggttgaattaattattcttaaacctttactaattaaaaatttactcttctaaggcttttacttatgttgttaagagaataaatagtagaagagaaacttaaccaaaagtaaaagcggaaattaaaatgcacagtggaaattaaaagagtagggaagaaggagacaaacacacaagagtttttatactagttccacaacaacccgtgcctacatccaatccccaagcaacctgcggtccttgagatttctttcaaccttgtaaaaatccttttacaagcaaagatccacaagggatgtaccatcccttgttctctttgaacctagtggatgtaccctccactagaactgatccacaagagatgtaccctctcttgttctcagttaaacccaagtagatgtaccctctacttgtaccacaaaggatgtaccctccaatgtgttaagacaaagatctcaggctgttaaacctttgatactttgtgaatggggatacaaaagaattctcaggcggttagtcctttgaacacttttgtataagggaaagggaagaatcaaaaaaattctcagactgtgtcgttttgaattctttgacaagggagaagggagacacaaaagaattcaggcggttagtcctttgttcttttggaaaagggagaagagagacacataaagaattcaggcggttagtccttggcgaattctttttggcaaagggataagagaatgaaaagatgaatagcacaagttttcaaggtttagaaaaccagaaaactttggaaagcttttggcacaaataagaagaagaagttcaaagagattcaaggcttgtaaaggattgtatgaattagtgtattgaaaagaaaatcaaagccttgcttttatagactcttcatgtttggccaagaggaccatttagaagagttataacttttagaaaaacttaaaaccaatttgaaaaagtcaaaaaccttttgaagagttacatcttttgatttattcagaaacaatcactggtaatcgattaccaaatcagtgtaatcgattacacaaggcttttatgtgaaaggatgtgactcttcacatttgaatttgaatttcaacgttcaaaggcactggtaatcgattaccaaaacattgtaatcgattgcagatttttgaaattaattggaacgttgtaaattcaatttgaaaactttttcaaaaacattttgctgctggtaatcgattacaacaatctggtaatcgattaccagagagtaaaaactctttggtaaacatgttttgagaaaaatcatgtgctactcaatttttgaaaaaaaaaattcatacttatcttgattaagccttctcttgattcttgaatcttgatcttgattcttgactctaaactttcttcttaagtcttgaattcttcttgattcttatcttgaactcttgaattgttcttgattcacttgagttgttctttgattgatctttgagctttttgtcatcacctttgtcaccatcttttgttatcatcattgttatcatcaaaatacctttgaatcacctttttgtcatcacctacggattcttagacgtttctagtattataagtccttaattttctagacattttactatttgtgccctgtatttggattttgttatttatcactttggttaattttgtgctttgctttggatatttagcatttggccggtttatgccttgctttgaatattttgcacttgcttctattttatattttgctatggatgattagtttttgttgttggttgtgatgcttgctctagatattttgtggctttgatattttcttctgtctttttcagctttttgatgtttcctaagggtagagaaactaagggtggatcttatctaaaactaggcaataaattgcaaatttaagggggagtaagggtgagtgcatgcattgcaaatcgaatatcgtttatcttgttttcagattgttgtcatcatcaaaaagggggagattgtaagtgcatatgttgtatgaagattttgatgatgccaaaagattaaagctattcaacgttgattcaagtcaagatcaagaaatcaatagaaacaatttacaatagtcctttatatgttaaaagaatctcttaaaaaggttacaaaggtttggccttaaaagacttaagttttcaaatatcttataaagtttttaagtaaatattacatcttgaaaattatgtatttctctctggtaatcgattacagcctgttgtaatcaattaccagaagcaaaaatgtttttcaaaaagctttcagaatcaattaccaatcacaaaagtttttgaaatttaaattgaaaagtcatgattcctcaaaattaattgtttaatcgattaccacatatctgtaattgattaccagtgaggaaatttcaaaaataactttgaaaagtcacaactcttcacaaagttttttgaaaggtcaccaaaggcctataaatatgtgacttgtgttcgaaattcttcagaatttttcagaacattcattgtcctattctctcacaagaaaacctttggccaaacacttgcaaaatcattaaggattcttataagttcttcaagttgtatcattctcttaaagagagaaaaacatcttttgtacttcaaaagcaatttgttgttgtaatcaagaggcagtgggtctcttgatttgtaagttctctgaacacaagggaaggatatccctgggtggttcagaagttgtaaaggaatttacaagtatagtagaaatctcaagtggattacttgaggacaggatgtaggcatagggcatggccgaatcagtataaaactgagtttgcaattctctcttccctaaactcttttactttattgcagtttaatatttactttgcatatttaaagaagcatcaaggaaattgttcattacttctttttttgcatattaagtctacatatttcttttaaagagagaattaaaacttgttaggggaaattttttaaacttaattcacccccctcttaagttattgaggccacttgtataacaagtaaggttgcattttccttataaccacaatttccattaggtctaatgtcaacaacttttacatgaactgttgcaacagatagggaaaattcattcatataaaggatttttttttgtccactttttgctactgacttctttgcgagccacacttggtgttctcaaactaccaaccatcatgtttcaccaactcgttctcacattaaaggagcacatttagtagatttcacagacttcaatgcaccctttgtttttactttctttggaggcaaacttattaaagtggtatccgaaaatgcaagttcatggaccttattctttaatgtcatttttatgctcacatcaagctatgaaaatctctttaccaatgcatcaacctcatttgtgagagttaagtccccccaagaatcacctgcgttgtgtgtaccattgatgaataacatcttccaatgcacatgaatggacaacaagggtattgaaccattgatttggctatacctagcaagtttataggcacacggtaaatcatgaatagttctgagtgtgcagtcacaattaaaactgtcaacactaatggaagcaaagcgcttcaacacaattaaaactttgtgcttcgtagtcttttgtaaaacggtgtattgaacttgtggtcaagcacgttgatgcttttttgaaatgacgccttaagttcagtatgttgcagtataagcatgttattcattgcatcccagcaaatacacaagtctcctatgctatcatgaaacaacctctttagtcttgcttgtgcgccttcaactctgtaaagtagtttaatgtaatatcaatagaagatacataacaaacaaaatgtgaaacaagtaagtaattacaaaaatctacctattagttgtgtttccaagatgcataacacaatcagttcatgcttgtacaaatctctccgtataatgcaacaaccatgtataataaatatactcttgaaaatccacataatgtctacaaatgcttgtaaagctttttaactactactcatatatttgttcatcaatagaattcaccaatcctacccaagcattcatcacaacctcccagtcttctgcattagtcacgagtatcttgcattttgctctgacattcttagaaacatggaattaacataacaagttggttgcaaaaggaaaggcaacctccaatgcattcatcaaagtaagatctttgttagtgacaatcacctgaggcagcatatcatccttcacaaacaatcctttgaccttttttaaatcccattcaaaattcttcatcctctaaaattgtaaataagcaaatgcaaaaaaaaaaatcatttctgttgaagtcacacaacaatctccaatagtggaagatgatatttgttcgtcttccaagtagtatcacaaatcaacattgtgggaatgcatttaatagcttgatgaaatatggatgagactacattatatctttgacaacatcttgagtgtccactcttttgaatcaatatacatattgattgtgctctatcaactttagtagatgttgtaccttcgttcatggacccctcactactagaaaaagcatttttcacatcagttctttagtacatttcatgacggttcaaaaatcatctttgaagtcgccatcatggaaagtcaacactttccacgatagtttttaaacagtcttagcatcttgatttctacatcggttcttttttaaaccatcttagaatgtgtttttttgtcttaaaaatgttttaaaaaaatgatatttctaagacatttttctgaaagaattatcttggaaagtctctaaacaaaccaaaaatttattgaggcttattatttatgaattaattatttaaaaatataatatttctatttggaaacaaaatcattgtttataatatattgaaagtaaaatataaacctaaaattattttatttttatttaaatataattaaaaagttataaatataataaaagattatatgttttgcatatgtgaatctacaaacaatttacaataataataaaggaggtatatgataatttttttatataaaatctacctagttttttcttatcatggaaatgaatgtagtaggatttgaaatatatacattctccacatacatatatatcatgaaatgtgaactacaaagttattatcaatggggttgactacaaaaattgaatgtgaaaaacaaactaaatttttctgaaattaaagttgtcctataaactaagtagtttcaagagaaagatgagagttagcacttaacataatttgtaattaaattatcaccatcaattcaacggtcaagattaatttctaatcgaattgggttcatcaaaataaaccttcaccacctctaacctcttcaattttcaaccaagggtcaataatttcgctgatcaactcgatgcctcttcaatacactactcaaagaggttgattcatcaccgctgggcaatgtagaactaagcatctcagacgaagatcaggatgcctcatcctgtaaccataaacaaattgcaaagattaattaatcaagaatgaaaatatcctctaataaattttttaataatgaagtactcacattgtaagactttcatctacttacaaattataaaagatcattagtatgatttttaaaataattttataaaaatcaataaacttattatcatgtatataataattttttattgaataataatataaaaactttctatcttttctttatctttgaaacaaaatattagcttaatatctaaaagcatattcaaagttaaaataataacaatgtcaaaaatgaaatccttgatagatttataaggtaaagtttattacttagaatagaccattacaccattggtatcactgatttaccgtatcaagaaaatacaacctcccaattgcaagatattatcaaaaaaacaattaataaactaatctaatattctaaaacaattagtccaaacattgccacaaagaatataaattaaaatttgcatagttgcaccatagagcactcacttagtgaaaaccacagaacgagggcgaagtaatctcgaaccttacctagtggaaagaaggcacagatctaaaggagatataaacaaaaagacaaagaagatgaagacacaaagcagattaagaaccttgttacaacccattccacaacacgtttatattttgaaaaaagagaaaatagtatattaattagtttttttcaccttttcaatcataaataataattaaattcattaattttaatcacaataataattaaaaataggttattactttttaattataaatttatgcttagaaaaatagatctcaaataagttagtaggcccttccctacatagcagacattgtggtctgaggggaaaaaaccgtgaggatacaaatcctagaagcctaatataatcaaactaaataagaacaagatttatatttgaagaattttgatccattaaaccacaaggaatcaagtatttaaataagaaagaatgggcaataagcagtcacacaagaaattcccttgaaagtacttctaataatggataagcattgatcaaatggcataacaattttacacataaaacaattatgtttcttaatcaatgacaactactttggggtccacttgttagataaaatgcatccatccatagaaaagggggttataaatttatattataataaaaaaaaatcagcatccttcgttcaacgtttctccaagtcttcctgatctagaagttgaaactctcattcaaatctctggattaacctgaactttgttctttgcaaagtatctcatcctatccctaactatattgtgtaatattcgatagtagaagcatttcaaatgaaaaaaaaggtagacttctttaaatctttcagaaggtagtgattcttttgtccgcaatgcgtattgagaaacacaacaatagtaatggttcaactttcattttaaaggtgaaaaaatatataataaaattaagtttaagcaacttactatgtatataccaatagttatatatgttaatgctagttcataatttcactaattaagagtgacaagaactacattctttaaaactgttgacatcttgcccaatagacatgaataaagcaaattacagatttgaccaatcatatagagaagcacacagacctaaattatgaaaaatgagattgcacacaaaatttgaaagttatctaaaaaataaaaaataaaaaacagaatttatccaaaaatatctagtatgtacaactccttttatccctccactttgtgctaaatagtaaagaggacaaagaagagaattttgagctgattgtgatgcaaattccctacatacctctaatccacgcaatgcaccaaaaatagtatttgcctagaataaataaaatcacaaaaaacttaaaagactaatggccaattagaaatgactatcattaaagaaataaaaagataaaccacatattgcaatttatttgtttttgtccattaaccataagaaaggaagcacaacatcataagagtcttctttatcaatcagtttgtttccctaaaaacaaaacactcaatgaacaagtgtttcaacaaattccaattgctactatgtggcattttagaatggtgttgatggattggttaacttgttcaatgcacagaaaattacgacattaaactaagaaatacatatataaaaggaaactagttttaacttaggaagggaaaagtacaacataaccttcagaatttaagtatccattagccaacaaacaacataatctcattgaatattcaaatccattaacaaacactaccataaaaattatttattacgatgcgccaacaaagatggttgacaaaaatcatctttgaagacaatgtggtgacaatgtcataattaagttcattaataacgaagacgattttcaaataaccatcttggaattgtgaatttaaggatgattattcaaaaaaccgtcgtaattgaacacaatacaaaaatggttttacaaaactgtctttgaatggttttgccttttcaaattcacgctttctctctctctctctctctctctcttatcttatcaggtctctctctcttattctcactttctttctcttgctctctctattgtgaaaccctcatcttcccttcccttctacatttgcaataacaacaaatttaatcatcttctcactgatgagttcgtccctgtcaacaccaatgccgacaagctctacgatgagatgctcaaccttcagaacattgtcgccttcctccatcgcaccaagatcaacgcctccaccgattcctccgtcaccaccggctccgacctctgcaacgtcatcactggcgcccgctagatccctggcgagtcacgcctcaacctcctctagaggaacttctccctctttcatgccatcattgcgcttctcgtccgttactcccccgacaccattctactcatcatttcctaccttgtcgacattctcacctatgtcgcttggaagcttgagctcatgtaggtaatgaactctgagagtgcaaattgattttttttcgcacaaaataagatggtttcctatatactagctttgacataataagtggtattgtggtagactaacatttttttatatattttccattgaatgctcttctcccccattaagcttgttcaaatttctatccattaaaagcagcctcctttaagtagacttttcatcttagtaataggaaatgaaaagtcccattcataatgacatttggaaactattactttttgatttggagattaagattatcttttaaatgttttcttcttcaaacatttcaaatagaacgcaattcccttataacatttatatttttggataagaaaatggacaataataaaataagatgtgtgttgttaatgctattctagctttctggaagctcaaatctatgaattgtttcagatttgatgtttatatagttcatttgtttttttttattttaggcatttggttgaatacattgggttgttcatttctggtgagcatggcttctcttgtttgtctgattatcctgcctgtaatttttggtaagtaatttttttgtcattttgtacaatacaaattatttatttctcaatagcaaatgcttatctacagaatacgaaattgaatactcaggtttattctcctatttcagtacaagggaaaccatcaaaggttgttgttgattcattggctttatttggaaatcgtgagtgccagcacaatgctaaggtagtattttttttttaatgaatcttgagatttttgtcagggttggaatcaaaccccccaaggtatatgacttgagattaatctttcttaaaaggaaaaaagtactaaatatatatgtttctcatatataagggtgttcgtctttatggtataaggatttctagttattttttcataataatcatttcatttatttcttttttctttatgattttgatagatcacttaatatatgtaacttttgtggattttcttgaataaacttgtcactgaggaggcttttgttcctattgctcctagcaacatgtttttctgacccataagttggtgaaatataaatggcctataatgatttgccaatctcaaatgcttctagtgcactggctattctcaatttttttggataattattagtacatgaaaagaatagacaaaaataatggaatttcttttggcataataagggggaattgtcataaatccataaaagaatattgtctggttatgttgaattgctctttttttctttcgtgttgtgttgttttttacttgttaacttgttattgagtttttttttttttttttttgctgtgttgtatgaatgagatcaatgcatgctatgagagatcggattgttattatttttattggtgtgttcagaaacaacaatatttatcaaggtaccaaagtatttttttaccaaattagaaattaacaaagtaattgtgataatagtcattcacatttattgggattgtttacaattgtctattggttgaatcattatttgtagtaaatattagataacacaagtattttaatatatagcttcaaaaggtacaagtggaagtgccaaattgttggaaaggctggtatttgtattattattggctcccatttgctcctttgattataagcacatgcaatgccttaattagcttaattaattatcataattaatgaattaatctagtttcttttgtcgtgaacataaatgatattttgtgtaattatagcttctcttaattaaaatgtaggttgttgtattgaaatggtagaaaattcctatggattgattctttgatgatattgttcttgtcaaagctgtaaacatacatttaacaatacttttttccccatttataaaataagttacctaaattattaccatgttcattcaaaataatttattgggttaagcatttatgtttatcttcaaaaaaactgtggtacatgctcttatcttatgtttaggagatagtatataaattgttaaatagttcactaaatttaaatttaaatagttcactctacctaattagtcagatgtattgtagtactgttaacattaaattgtcttagagtacataataaataaaaaagacaacaattacatgatcattttctgtcttagtttctttcacaaaattcgttggcctttttaatttttctttttaaaaaaagacattctaagatggagaaaaccatcttagaaagtctaccttttaagacggttttttaggaaatcatcttagaatcctcaattttttttatttaaaaaagacatttctaagacggttttcccaaaaactgtcttagaatcctcattttttttaattttttctcaaaaaaaataaaacattctaagacggttttcacgtaaaaacaatcttagaatcttcaattttttttttaaaaaaaaatacattctaagactgttttcacgtgaaaattgtcttagaaagttatgcttctaagacggttaaggaaccgtcatggaaagtgttgactttttatgacattaactttaaagaaggttcaaaaccgtcgttgtatgtctcaaataactatcaccaaagaggcttttctagtaatggaataacaaatagtcatataaaaacaaaccacacctcaattgtgacttccccaacaccagaaagggtttgggctcttcaaacgaacaaattgtagctttcatccactccaagttgaagctgcaacacaagttcccaatctcaaaatcaaaacttcttgaaaacccataaaaggaaaaacaaaaaaaaaacaaaatttaaaaagaaaagagcccacctcctcactgtataagtatatattggccaatggtagatgtggattggaggatgatcggtctaaacccgacccatatagccgatttaagtcggttattggcccaagcaacaacagccccgtctgtcctgatctgtaacgatgtcgtctcattcacttccttagcaaacaaggtcataaaccaccttcgcaactcaagcatacatgtgcagcatggtctctctgacgtggagtttacacgtgtccaggccgagtttgggttcatgttcccgttgaacctccatgttgtcctaaccgccagtcttcccatcggttcgcgattccatgactgacactttggtggcgcgcgactgcacctttctgcgttgttggaccttctgatcgcggtgattttgttctagatcgtgaaaaatgtgttgtggtcgaagtcgtggggtccacggacgtgcaagccggagaaggtgttctgagtggtgtaaaacacattgaagagtgctgctactgattccaatcttcaaccattgctacatttcttccaatccctcagtcgctggaaaccctaaaaaaattgaattgtatgggttattgtgacaaaatcaaagaagagggggagttggagagtgagagggacattgagaaaagactagagggagagacattaaaaacacactcacttctaagatggtttttacaaaatcatcttagaatgaaaaccttttaagatgatttttgcgaaaccatcgtggaatgatagttttcaaaactgtctttgttgaaaaacctcatatttacaaaattttcactttctgactttctaagacggtttttggggaccttcgtcaaaggtgcatcataaaaaactatttttttagtagtgccttttttttcgctgatatctttgtcattcattatatatggtcttgatggtggtgacatttttttttatcttgatctttgttgtcaacaaaagttttttcttcactgcttaaatgactaacctatgcatgttcgaccaatgtttcactaactttctggttatgaacaccacagacaacaaaatgtttccaaccaacttgtttgacaaacttcccttttaatttaaatgaacaaccacatttttttgttctagtactcttgcaaactaacttatccttatcttgcttgtactttccttcattttcactacccactacaacataaattttccttccattttctgacctatgaatgacaagaataaatcgaagacttttccacaaatctcaaacccaaccgaacaaattgtatcaattttcaaaaacctaaaaaataaaatatttttcttcacttaagcaacatacacatacataaatataaaatcaatcgacaactaatctacatatctcatcaattgtgaaatgattggaaaagttagggtaatcaggttagggagaggtcaatgtccaacccattgtcaggatctgtaggcattttatctgattgatctgcaaacattttatttgattgatctgcaagcatttcatttgatagattgagacagtaaaaaacaatttgactatcatcatacatgtttccaaaaccctaaggcattgtaacttcatcagaaaagatgtatttcaatccatgtatacactgcaaagaaccattcatgaaaaatcaaaattacaaaaaataacacataatagaatcatgattttgttgtgtatttgaaatttgacacaaaacaaaatcaagatttcattgtttactaaaatttcagatactaaacttttatcattagcattttcaaatacaacaacttttttatatatacaaaataattgtatatcaaataattttatccacataaattgccgatttaaaaattattaaaatacttttattatctaaacatataatctcgttatgtgtacataataaatgtatgataaaatcttcatatgtaacaacaatctaattaagataatctcctatttgaaaaataatttcttcacatatcaaattttaactttttatatataaaaataaataaataattttttttattgatttgtttctttgtactgtaagtagttattttgtttttagtattgggtcgggtccaatgatgagtggtgaactcccttgattaagtgcagcattccttgacgggcaagaaacagtataaaagggtctgcatgattttgatgttttgatctctctccaaccctaacaccaacttttttaattaattttgttgttgtgaattccatggaagcctccgaagaccaaacagatatcatggagccgcatcttgattattataccctggaagaagatttctcaacaagtttatttgaacttgatgtttttccacatcctaaagatccctaagaatctcacataactttctccgaacttgttgattttctcaactccgcctccaatcgtcaagagggttctcctcaccatcactaaataagtccaaaatggtactgtttttcgtcgactaataatgccttttgtttaaatattttgtgctcttgcaggatttcacattttgtttatcacgggttcttacatggatactatggtgagcaactacggtgttgtccttgctctagtgaagcatctttgggcgctgccacacactactacaaaaaatagcttttacatcggttgatttgggcattctacgatgatttttaattattatcttagaaagtcttcactttttacgacggttccacagaaaatcatcttaaaaaatatcattctaagacggtttttagctaaaaaccgtcttagaatggtatattgtcttagaatgtattttttttaaaaaaatgaaatatattgaggattctaagacggtttttttcaaaaaaaaaaatcatcttagaatgtctctacattctaagacggttctcttaaaaactgtcttagaatgtattttttgtttaaaaaaatattttaaggattctaagacagttatttagagaattatcttagaatgtgtttctttttttaaaaaaaaaaaatctaaaatttcatacattttttaccatcaatcttagatttctattctaaccacatgttatttcatatactttgcatgctaatagatacggaaaaaaaaggaaaaaaaaaggaacaaaaaatattgtcccctaaaacaagcataataggaagtcttaaacaatgtagttataattatgtatgcatgttatctaatgaaattgtatcaaatataaataagcaaggtagaagttataatttgtaatttccttctaggtggaacttcactcacgtgcactaaaagtgattagaaatagtttttgttttgagttaaaaaatttatattaatttttatagcaatttttttagtttaaaagcatctaaatataaattattttacttgaaaataaattttaattaaaatctattttacaaacactcatccaaacataaaatattattagtaaaaaaataagatgttcttagacgtagtgttgtattatgtatgatttttaaattacataattaatataaaaattaataaatttatcatgaaaacttattataaaataactatataattattttatattattaatgtgttaactattttaccttcatattattgtactatctttcatttaatatattatgtggtaaaaaatgttaaattgtattttattcttctttattagttgaaaatataattaaaaaataatatacaaatatcattaatgttgactattatttgcatatataccactgcaaagttggacaagacacacgacacactataatgcatgtgtatcatattaatatacatgaatagctattcacctaatatatattgacgcgatgcattactactaactaggtaccatatcaagcaagagttgacctctctacgaccagacctctatataattttgtaacaatgtttccctttcctacactccaagcgaaactttggattccatcagttttaaggaatcaggtatcttagtccgaagctcaagtatcaaaatacttaaatctatttaaggaattaatttctttcgatatatatttttgatttaaatacatttttcattcttgcaatttaacttttttttatttttgttcttgtaattttcttttcgttttactgtgttgcataatagatacaataccagaatatgtgattatgcaactacattgtaagtatgagcaactaaaggcgtacccgttgtgcagggtttaatctcatcttgacttaggcatataggtttcgtaggacctgcttcatctccacctggtaataaaatccagctataaataagagaaggaaggacacaacagttatgtgatatatagatatggaatgcaatatcctaaggatgatattcgttcatattgggtcatagacatactccttattaatggcacgctcaatgcattgttgtcttcaaaccatctgtgtaactggtcgtttgccttcataaaaaatcaagaccaatatctagatcaaaagaaaatctaaatttttcaactattaaaaataatttagaaactagctaagaaaaatttacttttaattcaacaaaactagcttatcactttttagttactagctaagtttttaactttcaactaaattttaaacttttagttacttttacccaaaataatcatataatataaactaatgtcaatttccatataattcaatgatggttggttttcttaattaaatgtgaagtttatatttgcctattctataaatcaagtagcaatggaaataaccataatgaatgtcaacctagcacaaagaaaatcaagacagaagggaaattatatcaaacataagatgcactccccctcccggtattacaggcatgagaaagtgaagaagaattatttagtaaattggtagaaaaactaaaacaaaaaaaaatatttgaaggctttagagttgtgtcgtgaacaaaaggaagttgctaagtgaaggacttactttaaagagtaaagtgatgagttatttgattgaaaaaatcaattgtcagatcatgattaaatgcatacaaatgtttaataaaatatgtagctatttaaatctctcaagtctcaacctttgattttctaatcaatgggtataactttcactttagtctctaaaggagtaaaatcagaacaaggcaatctgggttggacccacagaatttgagatgagcaaggggaagaggaaaaactagcatcattgatctgaacaagggagaggtggcacgttagctataaacaaaaattgtagcaacaagagacgagatgctcagggaatgacaactctttctcatgatctaaattatcccaaatcattttgtctttccattgcatagtccattttatttcacatacctctctattttcttcctatttttatccttgttcaaaggatgttgtgataaattaacgttaatatataattactctacttcaaaaacataaaaaaaaagagtctaaatcgcacattcctgaacagacatgttgcaccactttattttcaaaaaagaaaagaaaagagagtagccaaaaacaagaaagaatgacatgcaatggtagcataattaattagcagctatggaaatccctctttaagcacttaattttgctagcttaaattatacgttagagaatcaaccaaaaaaaaactcgccttaggaacaccaacatacagatcttctccctctgggtggttgatgatgactccatgtctaggattcaactcgttggtagctatgtcattgtacataaacaccactatgttctcttcttttagtccaccttttatcagcaactagtatgcatggcacacatctgcttgtttataatttaattcaattcatcacaacatccataaacaaaaccattaatgaaaaacacatagcaactcaaaacataaaactaattaattaattttagaaaataaataaaaggagacaccttggtctttaaaccaatccaaaaaaataaaaacaccaaaaccaaattaacttacttgatgcctgtagtttccatagccgtttgaactagccatgagaaccgcccatcgtgttcccacttcatccgagtcagcatccaccggttcagtcggtaactttatgactgagtcccactccttacggttcagcctcgcggctgcaccgtgcactctcacgagcaccaccatcatccataataggacattgtaccacgtcgttttgcttataatggagcgatgaagcgccatatatatcagctgagaaaaacaaatgtgacaccctctaccctcacaaataacgaataaaaggaaataaaatcatgcggatttttttttaaacacattgactttaaattgatttcaaaagataaagggttcacattcacttaatgaaaacatagtagaaattgttcgaataaaaacaacaaagttatcccggctcaaaacaaggtcgtccatgctgaatgaataataataataaaaaaactaaaacagaaaacataacacaactatatcgtttacggaaaatataacatgcgaagtaaaatcctatgccccaatgtcacacttatcagagcatgtctctatcacagactaagtctctccggctctaacatggaatttatcatgtgatggctcacctgaacaaatgacaatcagcccaaacacaaacacacactaggaatgagttatcacattcatatataataaaatattagagcatgtaaaacatataatacttaaagctgaatttatataattaacatcacttcccaaaatcacacacattttgcacatccattcaagttcatccactccagaaaataacatcaaaccacaattgttaactcaatgaaagtcaaacacatgcattatgcaacaaatactctagacttaagcctacatgcaatgtggtaccatttttcagtgaaaaacctcgttgggcgcctaagagtacatgacaggacatgcctcacaatgggtaagttaggtcactttcactaagtgaaatcatagggagaccagtcaggatcacgttgttttgcgagaatgctccaaccatgtgggagcggcacaggcttaaaggagcactcaaatcggatgacccccaaggcctacactccgaagagttcgtcagggcctctccctcctgattcaggtctaacccaaaaaaaaatttgaacacatagactctacctatgaattatgcaatgcacacaactactcaattgtgtgtgtgtgtatatatatatatatatatatatatatatatatatatgtatgtatgtatatttttaaaatatattttaactcagtgcacctcaagtgattaaactcgtcgggttcccacagtggatctcatcacaactctttgcgcattaactcgtcgcccttaaagggtcttacagttgtgtgattacataattcatggctcacaactcaaaacatagaacatctcaacaattatgtaattcacaatccattatgtactaaatgattatcacttacacacagtctcaaccacaatttcataataaaataatttatcgcatctcacgcatcctacacatatcattcaatagtaacatttacttgacacaataaaaatatagattaaccgaatatattaattcaacaaaataaataaataaaaatatctacaacaattaatttgagatgtggcaaaaataattatgattaagcaataattttacaaaagtatttaatttattattatacatatataactaaaaaaataaaaaaataataatgtcacaaaatatttaatttatttctccagagcagtaaaataatacattcacaacaacatttaatttattatatatatatatatatatattaaaagcaaaaaccatgtgttacaagtataatatctttaatgataaacgtattaaatatattattactgcaccttgaagggaatatttaacggctgaaattcatttataagaaatattaacgtatgcatttttttccaccttaaaaagaatgtttatgttgtaatttgttgatcaatttaatatgtagaaaacagtaacatatcaagcatatttgttgcgccctaacgtatcaaagttttctgttgtaattttgttagactatcaaattagtttgttaacaaatttgtcaagaaaaattaaaaatttgaaattaaaaggtgcagtcaaaccattaatttaacaaacatatttttgagactacaaatattttatactaaaatcaatccctagtcaagtcaaataggacaactataaacaatgtataactaatttgttggtttgcattttttttttttgttctttttttcaacaagtattacatacacgtcttacactattttcaaaagagttgtggcaaatttaaagcaacgattcccaaacagggaaaacaactcttatttcaattgaaaacttccaaatataatagtagggaaaaagatgacaataaattgtagttcattacaaacaatagacaatacaattatttgggtcaaatttttcattccaatgataacaattcactaacacattcaaaaaataaaaataaatcacaagcgcaaaacaacgaaaatcatacacgttaatatacaacaagaaatcaagtaataacaattgaaaattaaaaaaatctaatatacaccaagaaaatatcatatcaatatatactaacaggatcatagaatttcataacaatagatattacactcaatttagcgtaagaattattcaatttgaaagaatcatgaattaacattttataaaaacaacccaaaataccccaaaattgatcctctagaaatccttatacatgttcttctaatcctcaagcgtgagtaactcatcccttacctcgatgtagtcgctcaaacgttctccattagcaattgtggcatctctggtgctctctagagctcctcatctggttgttctgatagggttcttgtgcgtcagaaaaagaagaaagaaatagaagtgttttataaaagctgctctaggttaacatttggtttatatagtggaaaattatgacctaattacttttacttatttatttactaatttattaattttattttataggaaaacttaaaaaaaaaaaagcatggttgttacaacaaactcactcagtcactcacacacacaggagtaggtgttgggttgacaaagcagaggagtgaagaaagggtttattaatcaaaattgactcagttaaagacaatatgtcatgcaaatttagagcgcgacacattcaaaatcaaaacagtttgggaaaaatgatgacaaattcaaaaccatttcttaaaatgaacttttatactatgaataaattaatcaaaaacaatactttccaactaaacaatgacttattgtcatttctctacagcttccaagagatgaaaaaagaaccacgacagaagaaacaaattagggatgttagttaccagagagctgagtggttagatctactagaaaagatttaacacccttatcttccgttagcaacatggggaggccatatttcttaactttcacaaagctttcttctggataaactccacggttgtagagattgttgatcaaattcccatattaaaataaggcccaaaataaattaaaaaatgcaggatacaaggatcaaacttgatggcagcatatcctaatttgaaaaaatcaccaaaaaaaagatcaggcaaaagttcacaaaaaatacacaggtatgcaaaaatcaaagaaatcggaggaaagcgagaaaagagaaaaatgatatgaataccgaagaactcactaacgattgttgcggaaccgcaaatagtgattatgtctttggcaactgttcttgcggccatgtcttttctttggagtctaattttgagcaacgaacgtttaagttttcgacatagggttgggtggagcttgttcgcacgatgaagcaaaatgggaaagcttttgtttcgattgtgggaacactggtaagcgaaatgaactggttttgaaaaggggaaaataatggcacttaattagggattggaagtggaaagaataaaacttgatagagaagcaccatatccactaaaaaaggggtatcgatgttgtaagaagttggtgggtctttctacaagtccttgagctccttgaggatgcgctttgaagccatgggagggacgatacgcattcagatctgaaagggaaagagggatctggatatcaggttttggttgtgcagcaccaaaaaccacaatcagtgaaagagggatttgaaagggaaagagggaaagagtgagagtgagaggtctctgtggctctcgcttatggagagtgaaagagcgagtgagggagagcaaatgtttaagctctcaagagggagatataaaaattaaaaacatattctcttcgaagacggttttttaagacggtttttgcaaaaccgttgtggaagggtagtttctaagatcccatatttacaaaattgtcattgcgttacatactaagatggttccttcttgaggaaccgtcatcgttttactatcgtaaaaaatgctttttcgagtagtgacagaccattgagaagcatgaggtggagaacaaatatgcacacatccttgtaattcttgctattaaagtaattaagttctactcatccttttctccctaaatatcttagttaatgctatatattatattgtcattattgaatatataaggggacgaatgcattgaaattgctcttgaatgtactatttctctcacaggactcatccctaaaagggattcaaaattatagtgtaatagattattttatattaatttagtttacttttataactaaattaaaattattatcttattttatgttcattttcttcaaattaagatgtgaggtgtgacttaaaaaatattattatgttagtttttagtttcttttttatttattatctttgtaagggcatactgaatgaatttttagctcactctacaacatatcaatgtgtaattgatatatgatcataaacttaaaatatttattttttaacaaaataagaaacaactaaaaattcaaattataaatgaaaaaactaagcattagtatattaataatgaacaaaaatatgaaatatttaatatgaaatgatatcttgttgatgataaaaaataatgacctaacagaatactttctttgatagacagaacataaaattaaattgttataaatatataagtaaattaaagttataaaggatgtgatgagtttcttatagctttattcgaagttataaaactcaaccggaatggagatagatttaaaaaatataaatcaacctttttaaatgttggggatagttaatttatcatcgactcatcccattgtcatgtttataaatatttatgttatgtaattattttatgaataaattaaatgatagatgataatataagagtaaattgaataaaaacatgcaatatatatatatatatatatatatatatatatatatatatatatatatatatatatatatatatatatatatatatgagtctcattaaacctatgttatttgtataatgtaaaaaaatgtatatttataatcaaactatgtatccactttttatatataatatatctttatattttcaaatacttatatataaaagggtacatattattttttttgttatcggcccatgaaatcttgtgtgcatccaataacatgactagcacacattaattaattaaatgaaaaagtgagatggagagtcttgataattttaagggtgatgtttgaataaataataatacacattactctccaaattaacatataagtgaagaatatgggtgtgttggattaaatacatcaaccatactgcgtgcatgntacgtctctatgtgttttctatttgagtgttcagtagtatataatagtgcggccctcttttataagaaaagattatgggtgtctntgaatctctggtacgagggtccaaaaattgtttaagaataaaatagtttncaagcccgtgtgtttac

SEQ ID NO: 183 - DNA, 24 bp, artificial sequence
  Artificial sequence - primer
ctgtaaattataaacacatgccat

SEQ ID NO: 184 - DNA, 27 bp, artificial sequence
  Artificial sequence - primer
gctgaatttcagtgtagtggcgtttac

SEQ ID NO: 185 - DNA, 27 bp, artificial sequence
  Artificial sequence - primer
cccatcctcattaatacttcacaccac

SEQ ID NO: 186 - DNA, 30 bp, artificial sequence
  Artificial sequence - primer
gtagtggaagtctatagttgtatacctctc

SEQ ID NO: 187 - DNA, 14 bp, glycine max
ttaataaatttatt

SEQ ID NO: 188 - DNA, 17 bp, glycine max
ttttattatttaaatat

SEQ ID NO: 189 - DNA, 19 bp, glycine max
ttttaagttaacataaatt

SEQ ID NO: 190 - DNA, 16 bp, glycine max
cttatattttttttat

SEQ ID NO: 191 - DNA, 21 bp, glycine max
tttaaatcttttatttttacc

SEQ ID NO: 192 - DNA, 22 bp, glycine max
tttatttataagattatttaat

SEQ ID NO: 193 - DNA, 20 bp, glycine max
atgcaaacatatatacatgc

SEQ ID NO: 194 - DNA, 20 bp, glycine max
tcattactaaaaaaaaatag

SEQ ID NO: 195 - DNA, 19 bp, glycine max
gccagcatgcatgtatatc

SEQ ID NO: 196 - DNA, 19 bp, glycine max
taaaaagttgaatagatac

SEQ ID NO: 197 - DNA, 31 bp, glycine max
cattaagttcttttaattcctaggttagtgg

SEQ ID NO: 198 - DNA, 10 bp, glycine max
cgttcttcat

SEQ ID NO: 199 - DNA, 35 bp, glycine max
tgaatatatatagcatgaaaatgccttgcaaaata

SEQ ID NO: 200 - DNA, 22 bp, glycine max
aaatagaaaaggaaagaaaatg

SEQ ID NO: 201 - DNA, 39 bp, glycine max
aaaaagaaaagaaaggaaattcccaatcaaagagaaagc

SEQ ID NO: 202 - DNA, 45 bp, glycine max
gagaaagcaaaaagaaaagaaaggaaattcccaatcaaagagtgg

SEQ ID NO: 203 - DNA, 102 bp, glycine max
tacgcggagataccttacggttatccgcaccccctttgccattcagacacagtcgtgtccgttggcaagcagagaccaagtttggtcattctgcacacatga

SEQ ID NO: 204 - DNA, 19 bp, glycine max
gctcgcctgggcgagctga

SEQ ID NO: 205 - DNA, 31 bp, glycine max
cattaagttctttcaattcataggttagtgg

SEQ ID NO: 206 - DNA, 13 bp, glycine max
aaaaaccgtctta

SEQ ID NO: 207 - DNA, 11 bp, glycine max
tttttttttcc

SEQ ID NO: 208 - DNA, 24 bp, glycine max
atcaaataaaatgcttgcagatca

SEQ ID NO: 209 - DNA, 76 bp, glycine max
aaaaaaaattgaagattctaagacagtttttagggaaaaccgtcttagaatgtcttattttaaataaaaaaaaatt

SEQ ID NO: 210 - DNA, 21 bp, glycine max
aatcaaagaacaactcaagtg

SEQ ID NO: 211 - DNA, 65 bp, glycine max
gatccacaagggatgtaccctcccttattctcattacaacaacccaagtagatgtaccctccact

SEQ ID NO: 212 - DNA, 61 bp, glycine max
aagggagaagagagacacaaaaagaattcaggcggttagtccttgtcgattctttttggaa

SEQ ID NO: 213 - DNA, 24 bp, glycine max
tcttctcttgaatcttgaattcaa

SEQ ID NO: 214 - DNA, 13 bp, glycine max
agaaaaggaaaaa

SEQ ID NO: 215 - DNA, 24 bp, glycine max
ggactacacgtcctcgccttcaga

SEQ ID NO: 216 - DNA, 187 bp, glycine max
gggatcgcgcccacaagacacccagtggacccgaaggagtccaacagggccctggggtttccagctctggttacgggcctctgtcagtcctacagggtgcccgtcccccccagcaaggtcaccccatcgtaacataggtaactatgcacatctctcaactgatttctgatgccatccaatatttgca

SEQ ID NO: 217 - DNA, 71 bp, glycine max
aaaaatacctcacaaaatatatatatattatgtttaggtagcaagataccttggatacacatgtatatagc

SEQ ID NO: 218 - DNA, 44 bp, glycine max
aaagaaagttcccgatcaaagatcgaaagaaaacaaagagaaaa

SEQ ID NO: 219 - DNA, 137 bp, glycine max
gtatggttatcagcacctgtcgtcaaccaggggcaaacgagcccgttgacgcgcagagactaacgtcatcttctgcaccttttgtcaaccagagacagcgagtccaatgacatgtggagatacccaagcgattatcc

SEQ ID NO: 220 - DNA, 62 bp, glycine max
gcaccttttgtcatccagagacagcgagtccgatgacatgcgagggtaccgtatggttatcc

SEQ ID NO: 221 - DNA, 62 bp, glycine max
cacctttcgtcaaccaggggcaaacgagcccattgacgcgcagagactaacgtcgtcttctg

SEQ ID NO: 222 - DNA, 310 bp, glycine max
gcacctttcgtcaaccaggggcaagcgagcccgttgacgcgcagagactaacgtcgtcttctgcaccttttgtcaaccagagatagcgagtccgatgacatgcgagggtaacgtatggttatccgcaccttttttcatccagagacagcgagtccgatgacatgcgggggtaccgtatggttatccgcaccttttgtcatccacagacggcaagtccgatgacacgcggaggtaccgtatggttatccacacctttcgtcaaccaggggcaaacgagcccattgacgcacagagactaacgtcgtcttcc

SEQ ID NO: 223 - DNA, 245 bp, glycine max
ccgtatggttatcacacctttcgtcaaccaggggcaaacgagcccattgacgcgcagagactaacgtcgtcttctgcacctttcgtcaaccagagagagcgagcccaatgaatgcgaggctaacgatcgttatccgcaccttttatcatccagagacggctagtccgatgacatgcgggggtaccgtatggttatccgcaccttttgtcatccacagacagcaagtccgataacacgcaggggta

SEQ ID NO: 224 - DNA, 124 bp, glycine max
cgcagagactaacgtcgtcttccgcaccttttgtcatccagagatagcgagtccgatgacatgcggaggtaccgtatggttatccgcaccttttgtcaaccagaggcaagcgagtccgttgaca

SEQ ID NO: 225 - DNA, 51 bp, glycine max
aatccgtaaagtttcgcaacattctggaagtcaaaacaagtattgctgcac

SEQ ID NO: 226 - DNA, 10 bp, glycine max
ttcttcatcg

SEQ ID NO: 227 - DNA, 21 bp, glycine max
cgttcttcatcgttcttcgtt

SEQ ID NO: 228 - DNA, 50 bp, glycine max
ccaagagatcgttaatggtccaacgccttaacgtttctctcctttcaaaa

SEQ ID NO: 229 - DNA, 18 bp, glycine max
aaaaaagacaaaaaacat

SEQ ID NO: 230 - DNA, 60 bp, glycine max
atcaaacatcacttgagatcgtttcaaggtccaacgccttaaccattctctccgcttttc

SEQ ID NO: 231 - DNA, 71 bp, glycine max
acatctgagaagaaaactcattcgaccaggagctcatggaaaattcccaaagacaattgtgatagtagggt

SEQ ID NO: 232 - DNA, 31 bp, glycine max
ttttagaggactcaaagtcctcacctttatc

SEQ ID NO: 233 - DNA, 21 bp, glycine max
atcaaagaacaactcaagtga

SEQ ID NO: 234 - DNA, 25 bp, glycine max
gaatcaagaacaagtcaagactcaa

SEQ ID NO: 235 - DNA, 18 bp, glycine max
tcaagaatcaagaagaat

SEQ ID NO: 236 - DNA, 20 bp, glycine max
ttcaaaaaggttttaacttt

SEQ ID NO: 237 - DNA, 10 bp, glycine max
ttgaatctct

SEQ ID NO: 238 - DNA, 15 bp, glycine max
agtattttcaaaaat

SEQ ID NO: 239 - DNA, 23 bp, glycine max
tcataaatcatgcataatatcct

SEQ ID NO: 240 - DNA, 21 bp, glycine max
atcaaagaacaactcaagtga

SEQ ID NO: 241 - DNA, 25 bp, glycine max
gaatcaagaacaagtcaagactcaa

SEQ ID NO: 242 - DNA, 18 bp, glycine max
tcaagaatcaagaagaat

SEQ ID NO: 243 - DNA, 20 bp, glycine max
ttcaaaaaggttttaacttt

SEQ ID NO: 244 - DNA, 51 bp, glycine max
aaaggcacgctaagcccaattccaaccgagaggaagtgcactgagcggccc

SEQ ID NO: 245 - DNA, 14 bp, glycine max
aatttatggagcca

SEQ ID NO: 246 - DNA, 184182 bp, glycine max
atttaggtgacactatagaatactcaagctttacaatcggacaaactggttactatacaactactatgttttttcttttcttttcttttaatctctgttcccattttatcacaagtatttcttttttgtcatttattaaaaaaaagtaaggaaaattaatactgtaaattataaacacatgccatataaaattgtgtaaaaaaaaaataaacgcatgccatataaaaacacatgtcataaacaacgttttaaattgtggtctctggtcagcagccacaattaaaattcggcgacccaattttacctacgacaacttcaagtcttccactacttaccacacaatttaaaaaataaataataaaaaaaaacataaaagcgtgtaaacgccactacactgaaattcagcaaaaaaaaaaaaaaatcagcaaaaaaagccactacactaactttagaaaattggaaggaaaaaaaggtatccacaagccaaaacttagattaagaaataactaaattaaatacttcaaagtaaaaacattaaaaaaaaccccaaaacagcaaataattaacaataacaaagcaacaaatcacaaaattactccaaagttctaatcaactgttgtgttccgtgcatccacgtatcaaactcacgcgtcaatttcaacacacgctcatcgattcgaaatctagagcatcattacccgcacttatcgcagagatcggcgaattcgccggatcgcagggcccagcctttgcgccaccgaatcgtcgtcgaggtggcgcacgccacgttcatgcagctccttgactccattttcaactccaattccacacagactctgcaaaaaaaaaaatcagaaaaatcagaacgaaaaaccctaactgtcacctcaccgactcgcgcgacgccggatgtaaaatccggctgcggagaagcgcccgtaccgaaattaagcgggagagcgaagctcgagtggttcctccggtcgccggaagttcacgaggggaagttccggtcaccggaagttaatttttaagcggaggaggtgccgcgaggggtgaggtttgggattcgcattcgcgcgttgtggagaggaataatgaagtgtgatcggaagattgtcggaatctgaacggagagaaaccggagagagatttgaatggacgatggtaaccggagagagagagagaagagaggggtgaaactgagagaaagagagagagagaggaggcgtgtgcatgcagaatataagaaagaagaaagacagcaccaaaatgcatgcacgatgattatacttcaagactcggccaactcccccacttgctccctctttttttaatttttaatttatcatcattattattattctttttgtagcttttattattagcaatatcattgtggttgtattgttactcattattttatcttgtttcttttttggctagataatgtttagtattaattaaatattaaatatatgttaacattttttagatagtaatgtatgaataaaatttgttgatatttaatgtgtgaaaatacaaatattttaaatgttaaattatgaataagaataaaattttcttacattcttaaatgagaataattttttagatagttaaattatgttttagtccttagacaaaaattttagcatttttttgtctttatattattctttgttaaaaaatttagttttcttttttaagtcgtagcattaattgatggcgtgactctgttaatgataaattatttgattatatgttggactgtcttggatttgatagtgcttggagaaagtggattaaagcaacttgcttaagttgtatgtctactttggtcaatggtagtctaataatggagtttctggatgaaagtggtctaaacaaggtgattctttggtgtctttttgtcccttataatggttaagggattgaatgacttagttagtaaatttgtggaggcaggtaggggttaaaggctttgaagtttatgactttatttccttttctttaatacaatacacaaatgatttgatgatgtttggtgaggcatattgggacaacttgtgggctcttaaagccattccacgaatctttgagcctgtctctggtttgaaggtgtactgtccagggttcacgagtgacatggcgagtgatgcagcattgagtagtccttattagccctccatcttggtcagccctagaccatgaacacagatgttctctagaaggtcaaccttagcgccacatggctaagtagttaggtcattatgatatttcgatacgcgagtatctggctgtcaaggtagttacaaagttgttgcaatgcggttacacctgactaatgaggttgttatgatgttgcaacaacctctcaggcaacaccctaggattttcaccaatcactataaataatcaggttctatattcactttaacttaaccttttactccctcctcattcctcaggcagaggatactgacagattcaccaccacgaagatcactagagtacccacactaacgacggacaactctgatgttagtctggctccaatttttggcaagtacaaaaggtaaactctcttaaaagcaaaatatatggtgttaatgagcatgataattttatggttatggcatcaacatttcttcattgttcgactgcaacgttgccttttatattccttggaatagtcattggtgctaatcccgagtgagctaccacatatgatccaacttttagcttatttaagaaaaagttgtttcagtggaaaaggcgttatttgtctttagggggaggcttactttgttgaattcgatgttgttatgttttcctttatattatttctcttgttataaagccccaaagacacgatgtagctccatgttgagcttgtaggccttggatcttcctatcaatggagtcctttgtttctttaagatcaatggtagcgaaatggagaagaagaaaaatgattggagacgtcactttaaggagaagatgagtcaagaacaagctcatcactataggaagccatggataagagtttgaaggtagaagaagatgagtggagggagaaggagagaaggagcacgaaattctgtgcctcaaatgaggtctgaactttgaacatgagtagataaaattacaaagatggtgtatgtggagtggttttttggagacaaagaagatatgttgggttaattgggaagcagcaagtctccctaagttaaaagtggttttagagtgaaaaatttgaagttgtttaatatcagtcttctagtttaatggaggtggcaaattgtgtctgataaagatgcaatatggtataatttgctttgttttaaatatgagagattgaattcaaattctagtagtaataattcagtcagaaatacatctaatgagtggaaggatgttatgagtttagacaaatgattgttggtttcttaatttagttactcaaagtgtaggaaatggcttaaggatcttgttttggaaagataaatggttaggtgatacttgtttaatggctttttttttcgtcatctttatcacatctatcttacacaagataacgtaatggtggatatgggtgtatggacatcatttggatggcagtgttgttggaaatggagatgtaggttgttctgttgggaggaagaattgaatgactagctgatgcaaactttgtttggtgttaccttggccaaggacaatcaagattcttgggtatagagtcatggtggctctcaacaattctcagtagcaactgcatatgctattttactcttgatgtaatagtaaacaaagatttcctaggatttctatcgaagaatttttggaagtgtgtgtccctttccaacatgtctttttaaggaggctcttacgagattggttgctaactcaggtggctttacctcacagaggagttgcaaacgatggtactagttgtgttgtgcttacaatttgtggagaccacgaatcacttgatcttccaaaatcacttttcttaccaagtatggatatgtgtgtatcaatggttggcattttgtcaggctcaacacaatcagatgcaacaacattatgttcaacgtaggttgttgtttaggggggaaagaaaatgtgtcaattttggtatatagtttggtatgctacatgctggtgtatatggttgtagaggaacaattttcacaatgtcattttagtggacctagtttaggtgtaaggagtttattttagtggtatttcttttgccaacaactattcttgttctatggaatgtcttaaagattttgtataattttgcattcttggtaggatagtaagtctttgctagtctataatatgatgtctctattacatggttatatatttcatatcctcttaataatattcaattttatgttgaaaaaattgacaacctgacatttacattgttagttacataacttgtcaccttattgatgattttgatatagaaaaatatgtgtaattttttttataaattatatttttagtcctgtgtgttgttaaaataattagtggtattagactaattgataaaagattaaaaatataatttgtcaaaaaataaaatttcataagtaattattacattagactaattaataacaatgaaagtcacacataactgttatttcatcggttatgggtgatacttgataattgagactaaaattgttgataaaaaaaataaaaggggtaaaaagctaaaaaaaaaattgtttcgaaactaaaagtgaactttacaaaaaatttagggacagaaaaaaccctgtatcctttataatcaactaagagatagattttcttattaaataactaactgtaataaaattaaacaattaataaatttattttacaaaatttattttaaaaataggattctaagacaaatagtataatttatttaattaaaaataaaaaagttccgtatgtcgtatacgagaaaggaagggttggtattttatttttatatataaaattattaatattttaaaaaaacatgttcactagtttctttatttaaaattataaatatctgtcacttgttcatttcaagctcttctctttaaataaaataaattctattatatatattgaaacatatgactttttttaacagaagttttaaaaaatatgacttaaaaaatgagaacacagttttgtttactttatatatattgaacatcaaacatttgaatatgatcgactttcataataataaacagtaacatattttttctcactctttattttattttttatttttatttttatttttgaaaaaatcaaatagaaagttattaattaattctaatgttttattaatacgttttttttatctttatatacttttttaatttttaaactgtatttaagtaataaaagaatttcttgacatgataaaagcttgatttttttcttgatgatactattcacatgacctttttataaacaatatataataaacaaataattaatatatttccttatcttttgaatgctatttattttataaaataaaatctttagtatttatttttaaattttttaaatattaataaaatgtgaaaaatacctataaattatacacgagttaaaatattaattatcaaaagcattaaagtaattttctcattctctatcgtatcactttatagtagtatttttttttctttcaaatttcttctttttaatgttttcatgcaccctattttggtattttaggttgaacgttatcagtacccatattaaaaaattcatcaaaaaaagtacccaaattaaaatatccaaaagaacagataaatacgcagaaatatagcgtataatggaaaatgcgaccgctagcaccggaaaatgcgccacttagatacagttattttgatgaatttactatagtatcctttgttagccacaacgtaggagcacgtattcacccgtcaagaggtttgccctttttcgtccaatttcgatttctatgtggacccaattaaatattggtcaaccttccgaacattgaagtataaataatattcatctttatcttttatctgtatccgtactatatctatatttatattacactgtaaacacagataacaagaatattacaatatatgctagtaaaatcatgtagttataatacttttcctccaaaatctatgctttttacataagttgtgtaataaaacatttaattattttttttacaggttgtacttgtgaaactaaaatgaaaagtaaaaatccttgttataaataatttaatttatacatgtgataaaataaaatgatttttatttaataataaatcagctactaactttttttgtataaaattaattcaaacatatgttatgttaatcaataaatatatttttttagtttttttatatttcgataataaatttctaattgtatgattatcacatacataataatacgccaatttttttatacgtgtaataatatacatcataagtttaatcaatgctcattattgtaaaatattttgatagaaatattcaatagggtttaattattttatcacatcaattttgtagaggaaatttatcccatcatcatcttaataattattataatctagcgataaaatgattttgtacaaaacatataaaaatattttacaataagtgagtgtacaagttactaaacaagtgtgtctacatattaaactccaataacaaagcaattaaaatttaatatttagataataatacggaaaaacattttacattaagtgcgtctacaaattaaacacaaataacatagcaatgaaaaaaataatatttacataatagtagtaattcggaaaaacatttttatattagtattaaaagctttgacagttataactgttacttaaaccttaaaagcttcaactaatattttcttttaacagagtttcaactaatgtgtttggttggaaaacttaattactagtattatggtttttttttagttggaagcacgtttttcagttgagtaagtagaagttattatgacgtgagtgtgttgtgtgatgacgagggtgacgcaaaagtaaaggaatcacgtcgagtcgacaggtaaaagacaatgacagagccatctccatctgagttagtgccaatcgcacgcgtgattgctgtgcctggatttaaaatataaaatacatttaaatctatcttttattatttaaatatttttatgtttaaatatttgtacattatcttatgatatatttatttatcaaaataaatttgcaaactagtatgttaatttttgttgtatcttattttaagttaacataaattttttaacttaagataaatttaaaaatacacagagatagtattcgaatacagtttactatttgcgcatgacctaacattacgtatggattatgtaatacgcaaccaaaaatatctcgcggattttatcggttgatctttgttcaaattggcgatggccgaaagtgttatcttcaacatccttataatgattatgataatcaaaagacattttattttgttataattcattaatgatagacattaaatatgatttaaatttaattctaaatctttatatatatatatatatatatatatatatatatatatatatatattatttttttagttgtgattcagttttaatattttattatcaataaccatgaaataatgttatagaagatgatatatttattcacagtttcatattaataaaaattatatttctattttcttaacatatttatcttgttgatactatttaatttctattgatcgtcaataaatttatttatttttctttctcgcatgattgtgttatttgtgaccttaaagcataatatggagatagaattaatcaacataagtcatttgataatataagttaagtttatggattagaatttgagtttgatttttgtaaaatacattctttttgaaaaaaataataatttttaagtataattaagtctcacttctaattgaaaattaatcttataattaattcaaataatcaaagtttatgaacatacattagaatattattgggaacctaagatcctaattgcatatggtgatactaaataaaaaaaatgtacatacttcttaaattcaacgctgatacattaaaaaaaatcaacactagataaaattttgagtaagactttttctaccaggagacatatgatttttattaagtttttatgtgtaaaaatttgacttaattatacttattttctcatgtatcattataatataattttattctctaattaattgagtctcctgaatattataagtgtgagattttaatccttttgatagttggcggcattgattgatatggtattggcattaaactgagatagtgattaatttggcatcttatttgatttttaatttgacttgtttgattttagtccttgggagttttataatcatgtcattttagtttttttgtattgcataatgatagaattttagttttttaaagtgatgtagactaaaatgatgaaaacattcataaaatgttatagtttgattcaatcccatgtcacacattaatagtgtttattaaaccactatacctataacatttttttattataggtatacctaagcctaaataactaaaattataatatataagttaaatacaataatattaataatatcatttttataggtgactttaagcaattaattatactattcattcgttaactattttcttaattaattattttataatatttaaatacatattttccactttactaataacactgtttagtttttttttaatacggctttgtactctcatatgctattgaatcgggaaaaacacaatacaaattaagttaatttatgcaaaacaatttttttacgagattatgtaggaaatattataaaatttctatgaatattttgatgagcttaagaaaattaacaaaaccaatgttaattaattaatttctaccaggaaaaaaaaaaggcagaagccaatgaaatttaaggggtacagcaaagatttgtagaaccatcattaatattagtgcaacataccatgatgaagtgcatgacataataataatgtggagccaattgtgataagaacagaaaataaattagtgtaattgcatgatcagaataaagagaagatatatcatgttcatattgatcagaaaataaggcaacatgttaaagaaatgtgccaggtgcaacaatgagggaacaaaaaagagaaggataataaagaatgtggttatgacttttacaaaatcgaattatttacttttttaattttttatattttcctttttactttcctaatagttgtccgattaagaggaatttatggagtagattagattgattttgaaaaagagaaatatcatcttatacaatttttggtttttttaattcattgttcaattgatgtagtttaaaatttaaatatgatttaatcagtctagattgatctcaattttaagttttaattttatttctatttttttaaaaaataaatatttaagatatataataattgtgatacaaagtaatttaaaatatttctccaaaaaatgtaatttaaaatatcacatatatataaatcattttaaagctaatagtaatatttctataaaaaaagctaaaagtatatctctgttatataagttgataattatatttatatatacttgaatagttactgaatattataattaattaaatttacttttcataaataattttaagcaatgtaatatatatatatatatatatatatatatatatatatatgcttgtccctgctatatgttgatttttttttttagaaaacaatgtttttgacgagtgagatgcgatatatctattattgatgaatatcattattgtcttgattagacttgtgttgtttgaaatcctagagaatgtgaatctcagacatgaaagatatatgtatatgcataatgcgacttattgttgatgttgttattgatgaatttaattgatatgtggtgatgttgacatttatgatgatattgatttgagatgacgttgttaatgatgatcatgtcaacatgaattgatgttattattgatgattatgttaatatgaaatgatgtggttgttgttgataatgtcattgagatgatgagatgttgatgttgagagtgatattgaaatgagatgttgatgatgttggaaatgcgttgagatgaagcatgttgtgtatgttcgtgatggggtgcattgaccttgtcggatgtccctggtaggggaaaataaagtggttaaagagtttaagcatctctgaggggatgacttaggatctttaattcattcatggtcagtgtacttgatggtgcccacattttatacgttgtatgttgtgtatgttcatgggggtgcattgactttgtcggatgtccttggtgggggaaaatagagtggttaaagagttgcatgtgtacgacaggatgacctcgacacttattgtcttgtttttctaagtgagagtgtcgtgtggacacgcttatgctatttccttggggatggtaccacattgcatctaagagttgagatcaggtgcatgcatcatactgaacatgattaattggaactatgtatgaatgatgactatttgttgagtgtgtgttgattaatgaatgttgtataagctcatgatatttgttaatgttttcttgctaattgtggttatttgaatttagtattagttctttttataatgaactcacccttgcaattttgtatcgtgtggttgatacttgtgatgatcgcgaaccttgttcgtgggagcagaatgacagcagtaaggtgcagaaagtgagattctgatgtgaagtcgccgaactgacgtgatgacgttgagattattttgagagagagttgtgttttgttaatcaactccttcatagttggttccataatttttttgttgaattaaggatgtaaatcacaaacttaattatatgtatgaacaaatttaccttccattgtgtgaatgatgtgtactaagttactatgcctatatatatgtatgtattcatttaagtaatgatgcgttgtttcggaatgtatatcgtgaaattaaaattactttaatttttcataagcaaattaatggagtttttcatttaaaaattgaaatttttcgcagtttagagtggtgatatcgtaacgaagaggcgggccattacaatgagtgaccatactattagaatgaaaataagaaaattaaaaagttgagttagaaattttattatattttattttcaaagttaatatgtaatatatattcttgtgaccaacatgttattgcttagagtgaaactaaatctgttgcaaccaagtgactaagtgactgagtacaagtggttagtgtatttaaaataaagttgaatcgtttgaatattacctgagttcggcttaacagaaataattattggtaagactttacttagcttgtgactttagcatcatttcccatgatgaactgaaaagttaagacaaatccccttgagccaagattttagatttaagtcttacatattaaaaataattgaaaatagtgacttcgttaaagatgaataactaaatttctctatgaagatgagttatcagtatataaaattaataaatactttgtattaatgtcatggaaacaaatataatttatacttagtgcatgagtttaaattatagaaatattcttaaatattaaataaaaatataataatagtatattaaaattgttagaaaatacattataatttatcttttacagcagataaaaataattgtgaggagaaaaaataaattagaggataaatatttataaaactttaacaaactaataaaaaaagttttcatttttagagttatgtctatttatattacatgtaaagaaaatttaaatttttatgagtagttggatctaggactttaactacacaataatcattgataccaagttcacttaaatttatctcaacaattgataaaaacttatatttcataataattgttgatttaaaataaaaaaaaatattttatagaaattatatttattaaatatcataagagaaaaatatatctttttttaaatataataaaatattttcatttgctcatcatttctttgttgacttaaattttctttctctctcattttactattgttgtttgagataatctcattatttttttttacttaactaacagtaatatttttgtatagataagatttgaaggatgaaatttcataaaaatataaatcaaacaattacaataaatatgtaacatataaaagtagagttgaattaaatgatgattttttatgccacaattttaaaagaattacttttattcctccctctagataccgaaaacaccaatttacttaagtagagtaaggacaagaccagatatttctgaactttttatcacattcccaacctgaaaaaaacatgaaataaaaaacattaatcacagaagcaggaatcaaatggatagaatagtttgtaagtcaagactaacgtgttgaaggggccatttgcccagctgactgactataggatgtgtatcagtcaaaaccttcaaataccgagatgggttaaggtaatgcaatctatagcttaaaaggaatttagaagtgaaaaataatgtttgcttcatattatatctcagtcaatttgggaacaatcttaaggagacaccgagacaaatgttgaggagcacggtatgccatagcaccaagtacttgtacactactttgttttgtcctccaagctttaacttcaagaccccgaacaaatagattagctatgcgatagttcatcgaaatagatgttatggatagtaatttttttaatttgttcaatttacatgctatgttggaatgaaattaattgaaaagaagcattgggctgtaaacaaggttgcatttcggtttgcagtatatttgtttgtactgacccatgatgttatgattgctctttcatcttgcttagcagtaaacgatacataatattgcatgacttaaaaagaaaggcacaaataaggagatttgatgtttgcttgcagaatgcagattgatttatgcttgaaggctgacaccttgccattttatctcctttattgtattttaacatgatgttttaatgtttattgaagctcatcatattggacgtgccactggtagtgggctagtgacaaggtctttgggtagtttgcaggtgatactaggttcaaacatttgtgcaatcatttttaagtaattgcatttcatttggactaaaactggtatagtttattggattgacttttcaaaaacaccatgtcaatgtgtgcaacataattaaattaatatagatgtaaataaaatctcaataattagtcaattacatcaataaaataaataatgtcttaacaaaagaaaatccaaacaataaatctaaaatatgaaatttaaacatctctaacaataaatgattccatatttgaagtagcttgaacattctccatctccacatttaagagtacaacaaaaatgaatcagtcccaacaaaaataggataaaaacaaattctagagagagaagagatgtactttgcgtggtggcacggtggtgggccgaagctgtgtcgctgtggtgtgtcgcgtgactgcgtgaatatgagtcgcgttttgttttccttgtaagggaaagagtgttaaatatgatgtgaactattttttataataaaaatatattgaaatatctttaaaaatatttatttaacaattatttttagcttaaatgataagaattgatatttttattatttatgacttgcaaatatgaaaatgatagattaaaagaaaaaaagatcgagaaaatatcaaaaaggaagatttttagcatgttatcacttatatttttttatcttaatcttttatttctgttatcttttatttttcttatcttatcttttttatctttaccatcttttaatttaaatcttttatttttacctttaaatcttttatttttacctttaaatctttatcttatataatatatttcttcatttgttattttaaaagaaaagtttaaagtgaaaaagagaaaatcaaacctaatataattgggtcagggtcacacaaatcaaaccaaatgcgggttgcgggcaacccgtggaccccgcggccaaacccgcatagtccgcgggttaagcggggcggaccaaaaaatatgacataaccatgaactgttttaaaaaattggttcgtaactcgagcggatcgcgggcgccacgggccagtccatggacctgggcccatttacccacccctagtctacaggttcctgatcctttgcgattaagagatgaaccctagaggcacatcaatggcctctatggaacttctcatcgaatgtgaagcatagcccgtgcttatggcgcgaggctaactcctccggggtgagacgcctgacggtcggagcctatggcggggaaggcagcaaagggggcaaaggcgtgatacgagggggaaccaaaggggctggtggtggagctaccaacggtggggtcgcggccgcggtggaggcagacgaaggtccgatagcttctgctcctggatcttcgcaaggctggcggcctggtccacagtcataggctggtggacctggactgtgcggcggatctccgacgtcaaacccgagatgaagcaaggcaacaggaagggggccgacaagccgataattctattagccaagtcttcgaactccttcaggtatgttagcactgaacccgtctgagtgagtttgaacaaggcatcgacaggatcctcatacggtgatgaggcatatcggatttgtgcaggaacagaggtggagtggcaagggactggtgtggggttgggcgtggtggaggaaggcacaggagcaaggcggttgcgaagcttgtccatattgagggtcatagagtgcatggtattgtcaagacgaacaagggccttgtcgaggttgcgtgaggccatgaggacaaacgagagcaccaattgttacgaactgaacataaatgcaggaaattaagagctggcttcgaggcaccagaacctccagaggaagaagaagagcagagatgagagtaatttgctaatttcattcatatcgtgctgcttattacatgctattgtatttatactgatttctacataacagattttgtccttttgtgctagaggaaatcagaaatcgttattcttgtctcccttgcttctagcacagatcattcagcatcattccttaggatcacacgtagtccttaaggtaagcaggcttcgagatctttcttttggtattaactgctgcttgcacctccttttctacttgatttacacccttctttgctatagacacccctgtagttgctatgtcttgattcacatctattttttctgaatacatccctttgtatgctatgctatcactcttccctatcagagggggtctctggttttgtttttcctaattaccattatgtaagatctagcttgtatccgccttcttcttcttcttcttattacaactttttcacaatattctttactatattagcatctaggccaacctgataagtcacgcaccaccataataataatatttaacttttttttattttttaaagaaaaattaattcctttatttttttaaatattatttttatattaaaatatatttagtaaaacagtaatattaaaaaattaatttatttttaatgtaaaaataatatttaaaaaaataaaggaattaatttttctttttttaaaaaataaatttttatttaacaagttaaattaataaatgaattttttgtttatagtatttttttaaaaatgtataaaaactaattatatatatatttttaacaatttatttatactggaatacattacatcataaataaaatacatgaacaataatatttatctaagaaaaaactgaagatgaagatatattgaaataattttttctgttatgtttttattatcgaaaattttcacatttttttttctagaatgaataccatagttgttaggtaaaaaaactatggtaggttgtaacatgtctccttcccaaggattaataatcaaatgaggttgataatgggaatgattcatgtgttagttgtttatgctttcattattttcatgtttcaattattattgttagtccattctgttatttttgctttattatatgttccatttatgatgtttgtctctttaatttttaatattttatgttatttgagtattttaatttcttaatataatataattaagatgtgataatcatatatttattgggtttttaatcaatctatttttttaatcactttgttttttaaatttattttaagattattaattaattattttcaaactataaataaataattaaacaaaaaatattctcattatttaaaaaacaaaataataataataaaaaatttagttatttttttatctgaaaataatatttaaaaaacaagtaaattatttttaaaaaaatataaaaaaagaatttaataattttttttaaattaaaaaataataggagcaaagagaagttgggttccctaaccccgacttctctctgcaagctaaaaaggagtgttgtttaggaaacaattttgaggcaggtgtattttggaaaaaatgaggagagagcaagtgtagtggagtaaaaaaatcctgtaaggttttgtttggtagtaaaaagaaaaaaataattgtaatgagaaaaaataagttagaggataaatatcttcaacacttaaacaaacaaataaaaaagtttttctaggaagttcacttaaatctattttaactattgataaaaatttatacctgttgatttaaaataaaattatatttattaaatatgataggagaaaaaatattttttacatatagtaaaatattttcatttgctgaacttaaattttctttatctctcattttactattgttgtttgagatgatctcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagataatggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacaaagagaatgggatcaaagaattgggaggactttcaaatcttcgtggtcgacttaaaattaggaacttggagaatgtttcccaaagtgatgaagcgtcggaggcaaggatgatggataaaaaacacattaatagtttatggttggaatggtctagatgtaataacaacagtaccaacttccaactagaaatagatgtgctttgcaagttacagcctcactttaacattgaatcgttgagaataaaaggctataaaggaaccagatttccagattggatgggaaattcttcctactgcaatatgatgagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatctcggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttagccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttgtccgattaagaggagtttatagagtagattaaattggttttgaaaaagagaaatatcatcttatacaatttttggttttcttaattcattgttcaattgatgtagtttaaaatttaaatatgatttaataagtttggattgatctcgatcttaagttttaattttaattctattttttcaaaaaaaaaatattaaagatatataataactgtgatacaaagtaatttaaaatattttaccaaaaaatgtaatttaaaatatcacatatatataaatcattttaaagctaatagtaatattttctaaaaagaagctaaaagtatatctctgttatacaagttgataattatatttatatatacttgaatagttactgaatattatatttaattaaatttacttttcataaataatttttaagtaatgtaataatttttatatatatatatatatatatatatatatatatataataaataaaaatataaacatcaatgatatcataaaattttggtaataataatttttaaaaaaaaattgtgaattaactaacctttcaggttctagagtaatttattaatccaaattgccttgaagcatattcccatgcaagtcaagttgagggacttgatggaggccatttctgaaatagagttaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggcaaggatgaggagactttatttcatgtaaaaaatattttcctaggagtatatatatgatatatgattatgttgggtcatatttatggtatctcaaggtttcaattgacagttttggctatctcggaaattttccttgtaccaaaatattaacaattgaaacatgtttcaaatccagttacttttggtaccatagaattgaaattaatttatttcaaatacattgtattcttaatatattaaatatgttaatttgttattttttttaaaaaataatcattagaaacaagttccggtataggaggcatacttagtgtttaggctaaggaataatgccaccgggttcaggaacaagcctgttgaggtgtcccttaacgttccgtgacatccccactcttgcatggacattctgtgcagagaaacgatgggtggatggaggtaagattgggtgagttctataatagtcactgatgagaaccccaagagcagcattgaagttcgaggaatccaaataagaccagcgtaaattatcaatttcatctcttaaatagtcactaaaataaaatataaattaattctttcaagtattgaaacattcttcaaattaatccttatacattgataaaatatttcaatgtatatatgcattaatggatatttaacactttagaaattacttatatatgattttgttattttaaggactatttataagaaagagtaatactctagatatcaaattggtagttaatttaattactcttgaaataagcatgctcaatttataatatgttgttttgttggcaattaaataagcacaccctctctagaatggtgtgtatgtacttttctgtatatgttgttttgtttgtatacttttgcttgcatagatcccaaaacaattgggtgattttcattcttctataaattttcttataaatatttaagaaatttttgctaacacaagactggtgatatgatgttaagattgacataacaaggacgtgagagttcaatttttcacatgccatgtcacccatcatagtaccttgttggcatgtattaagtcaacaacaaacttccattttaaccatatctttgatcaccgcaaaaaattattaaatttactattaaattgtttatatttatttttctttattgttgggctgagatttttttagttactaaaattataaaagtttttttaatctctgaattttgataaattgttctttttagtttctgatttaataaattaatattttataataattttaaaatgaaaaattcaatggctaaaaaataaaaatcaattaatggttgctaaaacctaaaggatgttgctaatcagtgccctaaggcattagttaataaattaaaataaaaaaatatttattatgaaaatcataagagtatgtaaaaaaaatcataaataatactattttatatatttcaataaaaaaattattattttagttctttataaccaattaataccttaaaaacactagttaacatttaccataattaaattaactaattttgaaataaacttcaattattcaattatgtcttaataagcttgatttttcccttactactgcaagtttgcatcctttattaaagtgaagtgatgaaatgttgtctgccatttacgaatatcactgaaattaaagttgttttctagttgaatttataataagtttttttaattgataaattttaatcgttattttgtgagtttttgttagtataaggaagtaaagtcacaaattttcttttctttcataattttttaaccatcccatcaatattatatctccatttacaataagttaataactagcaagatacccatacatttacgcagatcgctctccttttttacgcatattcaaaatacacttgcttaaaaaagataattagctatttagtatttatattcaataaacatgaaaaaaggattagaatattcaagcaaaaaaaaaatcaaaatcctaatttttaggctatttaaatcattgtcttctattatttgaaaattgaaactattattcatatttttacctgttttatcttcataaattctattttaatatatttattatgtatttatgtaaaaaaatcaacactattaaaattaatttaatttgtgatattattcagtatttaatattttgttataaaaatatatttaataaattaatattaaaatatttcttatataattatgaaaaaatgatatttaaacttattttataaatattagttaataaaatttccatatatgaagttattaaaaaaagagacaaaataatattttgtaataaacatattacctaattagatttaaattaattaatagtataaaaatttcaactacataacataaattattcaaaaaatatttcattcataaaattattttatacggtttctaagtaaaattgattttataggatttcaaatttttaaaaagatatcgtggattctttaatatgttgttatgttaaatattcttaaagaaaaagctttgtcacccataataattggcctgtaatgacgttaaacacgtgattgtttttcatgaatgatatttttggtctctatcataaaaaatatatattaattaaatgtattattgagtaagtattttaaaagtattgtattaaaaattatatttaataattaaattttagtagttattatatattatgtagaagtgattataaagtaaaaatgggttttcaaattaaaaaaaaaatattatttttactctttgatatacaattgtgttaactactaggcgaaagaactgtgtcatttgtaataattttgagtaggattatttctcatcaatgattattaagatccctgtcatgattaaaatgattttaatttatgatattattaagtttttgatatgaatttgtgtgaaatacttgaagaaagagcatattcagtaagtaacctaaaactattttgtaataaaaatacattttataaattgattttaatatttttattactacatattatgtaaaaattaaaattaatataatttatgattttattgagtaagtaatttaaaattatattgtgataaaaatatatttaataaaatgttatataattatgtaagaatgatttccaaataaaaataatattataagatttgaaagtaaaaaaaaaaatactatttcagttttttttatgtgtagttgtgttaactacttggataaaaaaaatattgtggtctataatagtctttggcaagattttcttgtcactaatcatatttgtaatctctagcataactaaaattattataatatatgatattattaagtcttttggtatgtagttttataaaatattggaagaaatagttttgttgcatataataatccaatttcgagtaggatcctttcttatgaatgatatttatgatttctactacaaaaatatttaaactaattaagtttatgagattattgacgaaatgatttaaaattagttttaataaaaatatatttaattaattaattttttacatagagtcaaaacattattttgtaataaatttgttaactaattaaaattaaattatttatagtataaaaatttcaaccttataatataaatattaatgaataaaatatttatttataagattatttaattttattttatatgatttctaattaaaactaattttataaaatttcgaattaaaaataaattgttgagtctttaatatgcaattgttttaattactcgcgaaagagttttttttttcctataatggttggcccataagaagaattatttttagtcattatcccaaagagaataaaactaatttaatttatgctatttcttagtaaataatttaattttttttaaaataaaaatactaagtgactaatcttcctcaagaattctgagtgcacataatttgactattcccctcccaacccaatttatttcatacacaaggatcaacgggggactaatatattaattttaatatatctattatatatttacttaaaatgattttatagaatttaaaaataaaaataattattattgaatttttggtttgcatttgtgttaactactcagggtaggaacattgacgtccataatgacattgagtaagattgtatcccatcaatgatatttgtgatctctatcatatttaaaattatttaaatttatgatattgttaaatctttaatatgtacttttatgtgtgtttcgttgcatttgcacataagatctctagtaggattattttacttgaatcatccaaggttgttaaactcatgttttaaatcgtagaattgtatgattttacgattccactaagcttcagcgagttaaatcgaaagcagaattgaaaacggaatagactcatctgatttagcgcaaacttgggcgagtttgggtagactcgcgagtctgctacgagtatgtggatttacgaaaacccgaaacggtgtcgtgttgtagctacttatttgagtagactttgtctaccttgttcgagttatgcaaagtgcaaaattgtttggttcatgcttcttggcttcttgctgtgatgcagtcggtgctagagtgctacggtggggtgcgacggtgaaaggaggttttcggtgttggagtgcgactgtgcaagtgtgtgacacagtgcttctggatcttttgttggaaggaggttttcagtgaaaggaggttttcgatatatgggatcaaggtgatttgttgcgaacaaaagctaaacttcaaattgcacagggccagttaaggaacaaaagctatactgatatacgcagttgctagttgttcttcaaattcagagtaaaggttttaatttggttctgggaagaagctatacaaggtttgttgttgtaataacttatgctgattgaatatttctgaaccatgggcctttattcctgttatttactgttagaattggatgaatgcagtctcatgaaccttttgaatttattagatttttcaagaaatttgtgatcatgggtttgttagaaaaaaggaagtgtcctgatagtttgtaccttagaaagtgagaatattgatatataggaaagtaatagtgagagtattgaagatttgatcaccattttatttggtttgaaatggaggcatttcgtgaaaaagtagagtgcagaatgcatagagttcctcagaatttcgcatgtgttgatgaagctttttgaagcatggtacacctttaagggcatactactgttgggttcatatattttttggtttaatgagagaattgaagatttgatcaccattttatttggtttgaaatggaggcatttcgtgaaaaagtagagtgcagaatgcatagagttcctcagaatttctaacatactactgttgggtacaccttgaagcatattcccatgcaagtcaagttgagggacttgatggaggccatctctgaaatagagtcaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggaattgttggacaaggagggtttcactactgacaaactgctaactcagttggagaatgttgtgtaagtgttaatgcaaaggacaataccgaaatgcatgaaaagatcatcatctcataacagactctttcacatacgaccgaccacctcaactgcaatggcatattttggtgaacgaaattgttctgactcacgtagattcaaagtgaatattcataaatcaggcattttctttgctttgtgacaatgtcactaaaccttcaattagttgatcttgttctagctctatagggtaataaaagtatatcaatgtctgcaaaatacatcaataagatcaagacaccaaaatatatatatgtgcttgaattatttataaacttttattttgattccgggttacaacttatcttaaaatattttcttttttctctgtttcttctttcaagtttttaatttaacttcctgggtaatctagattccataaaatacttctggaaatgcagatatgatcttgttttttttttttgtattttactattctatatattttatattagtgttgtttattttcttaaaattatcatacataattatatatgctatatacttgttgatagggaagaagatagaagctggttttcaaggaccagggcctccacggagagaagaatgagaagaataagggaagggaacaattgtatattccattgattgatgttgttattacatagtattatttatactgatttctcaataatcgaatttgtctttttgtgctacagaatatcaggaaattgttaagtttgtctattcctacccgaccagcatcattcttccagatatgatgcacctgcttgtttcacacctaatccttgaggtaagtgggtcttgtaattgctctcttggtcttgttttctaattgcacccccttgcttctgttgcttgcttgctgcaagttcccactgattcaaattccaacagttctgcaaataaaattgaagaagaagctagaggtgggaaatactcaagtcattctcttgaaaaagttgctgcaatgatatgcaacaaaatatcactatacggagtcaaggtaattattgtgtttcacatgaacatttcttccatgaaaatatatatttttttactttgtaatctctttatagtatgcatggaaaattaattttctgatttttttctctgtagtgttatatattatttttaatcacattttcttatttattagtttgtttcttatttgacatcatgtaaatttggagatttgggttagaaatgtttttggaattttcctggttagaacttgataggtccataatgaaggtatataaaaggatagggaaaagagggggtggggaatagaaaaagaaaggacaaatgggcctcagaaacaagacatgcttgtgtatgacagcagaaagaatcagccgtacaagttgcactagctgaagtggaaaaggaacataggttggcataatggaatggatagcatttgatctttaataaatttttgctttgtaataggttcctaatatttaaaaagttttgtttgaaatacttatcattagtcaaaatctgttatttgctcacacgatcgttaaccagccacacagacatgtcatgtgtgatttttgtctgactgagattaggattaatgataagaaactatagtcaaaatcccttgggcataaaagaatcattcttcagcaaataacggattttgactaatgataagaaactatagtcaaaatcccttgggcatcaaaaaatcattcttcagcattcctctacgttttcacacaacccattatagtttcttctatacctttcttatggatttgtcactatgacttcgtcactcgtgaagatccaaggtgaagaggtcctcaccaacgatttttaggatcttgcaatcaattttacattttcaaatcaaaccaagccaactcccaactcaagaaattcacatggataaggtttctaagagaacacatcaaaatagtttcatgggtagaagaaggtcaacaaaaccttaccctaaaatgcgattccgctcggtccattgcatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcggccaccactggtgttgccagtcgtgccactgctcgtgccagcgccagctaccaccagtaacttccttcaactctcaaacctcacttctctcccagtctctctctcacacttggccctcaaactcacttgtgtgtcgtaggtgaagagaaggaaatgatgaaaacaaagaggagggttttctttggggaaggggggtccatgagtgattttttagagaaggagatttgttgttgccatggggagccatggttcaagagaagaaaaaaagaaaatgggttagaattattgttgtgttgctgccatggggtttcaagggaggtttggggggttttggagacacaatagcggtggtgtggagctagtggaggagttggttggggactggtgggggtggtttggaggattcggggacttaatgatgtcgtttttttacttttttctataaaaaaataaaaaatcttacgtgatcggttatcgatcacatatgaagataatggatttcgactaacggcaggaacttcgaacaaagctttttaaatattagggacctatcacaaagcaaaaatttattagggaccaaatgcaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatattttctgttcgagattgattgaaattatcttatttgcttaacatattaaaatgcgtcatttttaatgatattattggtctatagtttttatgtaatacatttaataatgtttagaaatatttgtatataaataacttttatctattttttcaccagagcctatgaaatgtaagcacaggtttgttaatgagtagcacaacatggacagtttgtcaaaggcccaatagcatctttaatgggattcttgaactcaagaaccctatccactagatctactattattcttattaagagttttttaagatggagattgggttctaggaaaagaactactattttttcaaaaatattattttttcttgtgctagtaaaatctaataatccaaattggattctactattagaataacaaatgatagaagttcttgcatcctatataacatcatgggactcacaaaaaataatccaagaacctaaaatggattctttgacaaaaatgttctaagaatctcaatattttcccacttaagaaatataactatcaaatcaatataatatgaaacgagttcaatctttattgattcacttgacgcaagctatatgcacaactgacataatagattttaattctaaataacatgcaataaaaatataacaaacctgttccggaaaaagcctcctcaaaatgaagcacattcagtccccccacaatttttacaagttggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaagataaccccttagcttcaagcacacagtgcgtaaaagctaaagatgtagaagatcggaacatgatccgatctagaccagaacaaaacctaaaaccaaactactaactgatctataattttttatacatcataaaactaaaaaaacaaagcaaactaagcacataatcttacaatccctactgaatttactaaaagagacacagatagttgaggtgggaaatgttgccaaaccagaaatgaattatcacgggaaagtatggctgatgtggttacaattaggagtcttaattcatcttaaagcattaatattttttaacttaacaaatataattaaagagaagtaacgaataagataatgatctaaaattcttgtattgattgaaaatagcgtaaaaagatgtttcaaagataatgatacaaactctttaaatgcaaatggttacatgcacaaagcacgtatatatatatatatatatatatatatatatatatatatatatatatatatgaatatatctacgtacattcatatatgtatgtatatgcaaacatatatacatggatgcatatatatatatatgcactaacaaacatatatacatctggatagagagaggatcagaatagcaggacaaagacaaacttgtatttgttgcttccatactagaattgcattttcttcagggttagatgcatcaactgtgtgggagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaacaagctttgtcgcattgaccgaaaaaaccaaggtgacgttgaccaaaaaatagtcctgacaagatgttggtaaaaaaatataatcggttgatatcgatcacaaacatcattgactaaggttaacaaaaaaatttctaaccgacattgatcaaaaaataacttcgaccaaggtcgatcaaaagaaacgtaaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccatttttttatgtatgtaatacggtaacacatgtacctcttgcagagattggggagaaattgcaacttttctttttacattttgccttaaaaaaagtgttcatatttataaaaataattttctatttaacttggatattttttctcatactactacactaaggtatatacaacctaaggcgtgtttcttaatttggagagtgatgcttgattgattgactaccaacgaaggataatctaaaaaggagaaacaccatttataatcctcatgagtgcttatgtcccttttgccttgaggtagatgagtcggtatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaagaaggaggcagatgtatggagggcggtgtgggcatcagaaattttggtgtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgccgcatcaatgttgcatggctttagacatgattttaaattgcaattatgattgcgttgcatgcaacgaacctaaaaatcttacattgtggataattatggaaaaatacaaactgatgtgatcataattataattgtgatgtgattacagagtcaaaatacattagcgttatgactgcaattatggttgctgactacattttaaaaccatgactttgggtgtaatggtccatgttcgaagctagctatctttctttctactgtcactggtgtatatgtttttggatcttaggtaattttggtaccatttaatacaaatcattttgttggaaaaaaaatacggtagcctacatgcaatatacaaaataaaattgaattactatatattatcataaatagtagagtataagaagtaaagaaaattctaaagataaacatgcatttaaaaacatatgaaagaattttttaactatatatataacatctttaattagcttaatagaaatgcgaaagtacaataaaaaagcaaaaacataataggcgtgacaaatcggttgcttatatacaataaagacaataaagtttgaaactaaaaccttatccagactatccaaatatccctaattaatcatgaaaaaattagaacagaagacatttaataactatagcaacagtaacagcagcagctatagctaatggcgcgatcaccgaatcggaaaacttttcatcattgaagtattctatttcactaaccctaagcaagatctcaagttgatcgcgtgcaataagagctggcatttcaatattgaaaaacctctcaattgagtctgcaagatctttaattttagttttccacggtaagaattcttagccacaaaattgtatttccctatttttgaacacttgtaaacaacctctttgctcttcctcaatagttgtatcagtggctcaagttcctgctgtgaacgacccaacatattcctgtacttacctatctcctgccatgtttacgctacatattttctagaatgttatttgaatttcattaaaaatcataagaagcaagtttgaatttttcagtgaaatttttacttaggtttagttagacaaaccctatttaaagctatattgttttgcttatcggaaccaaaccaattagttcggtttgaatttcttagttaaatcaagtctggcttaaaccaaatcgagctaaccctaggttaattgtttcaaaggtcgggttgaagctctttaaacttgagaatgtgttctacaaaccgaagtaccttattatttaaagaatatctaatatttttttgtttttacattattgttgaatccattttatatgattttttttttacaaaatattaaactttatttactaaataagatttatataaaattcatgaaggtaaaagtaatatttttatcttttaatgtaaggcttggtttcactttcgtccttcaacttttttttatttgatttatttcagtgatcatttaatatttatggattcttccttaaggaatcttgatatttttctatagttttaattgttcttcggttatttattcggaaattgagaggggatcatcacctccaaagatttcctcgctcccattaacaaaaatgtctaaacaattaccttccttctaaaatttttgtgaagtacctccactaattaaactcaacatattctcccaaacttcattttctttgaaaacaatgttgtctaattcaagacgctttgatataaaatatttagtcgctagaacgagaaaaaaaattgaataaaaagaagggatttttttcttcttaatgtacttcatgctacttatttgttggcaatcattattaatatatattatcttatatgagacaattttcaacatttaaatgttaattttgtaagtatcttggtagtatccttttttgataaggaatagatattattttgagattatattatgatgatgaattgtctcataaaaacacgaggcaagcacttgaaaggaacaaattctctaatttcttagtgggtagtgggagagaggaagtaaacttgcttcaatatgcaaatgacgcttgacgcactctttacaggagaagcaaccatttctaaggtgcttaccataaaaagcattttgagaggctttgaacttgtctcgggcctcaaaatgaatttccatcaaggcttttgtggtgccttgggagtggatattgataccttgatgaattatgcaagcttgttgatttacttgagacaaactatatgcacaactgacaaaatggactttaattctaaatagcaataaaaagatatataataaacctgtttcagaaaaggcttcctcaaaatggaggctacttcaatctagtacggtagttgacttactaagtacgaaacaacaaattattaagttgataattaattaaacatgattttaaatacttacatatttattcacatgtaactataaagatttagtaagagcataaataaaaaatgttgttataatatataattttaaatttaatataataaaaatgtgtttgcaaaatagaaatataaatataaagcgtgacaacacatgtttttcgttaataataataataataataataataataataataataataataataataataataataataattacaaatgggttttgacaaaatcatacctggcgaaaatatgcagtttagtgacggaattaatttgtgattcatgcaatacaatttgtaccaatcatcatcatcatcataatctctttttcgttttatttatcaacgttgctacttagtacgaaaattatttgcacaaaatacaaacagaatgatgctatctgttatgaaaggtaaatccacacgaattacacgaaatatagaatggacggttatgattttataaaatgaatatcgattaaaaaaatttaaaaggcatgtaaaaagagatttacagacatcaaacttcgtgcgacttttacaaaatcctctttcctaacacagcattatattttccatacacaaaccgtaaactatagattctaaagggtatacctggacttattaacaactttttaagagctaatattcattaaaaataccaaataggttttgacataatcacacgtcgtgcagatttgacaaaaaaagaattcttacaatttatttttccctcaaattggtgggtaaaattaaatataatgtgacttagtgcaattatgtgaaaaacaagttgcaggcacttggtatttatgaggtgaagccaaaggattcgtgcaatttatttacgaaaattatatattggcatgaaacacacgaactgtaaactatatatagtcactaacttgtatacgtacgaactgtaacaataaattttaaaataaaatattaattacaaatataaaatgggttttgacaaaatcgatcacacctcgggcagatttgacaaaagataattcgccacgaattctttttcgtcaattatttaacacaaccttccttttacgaattgcacaaatccacttttaaaatacaagaaaattttgttttaaaaattcagccagccgacatagaggtgtatgcaggtaagtttggattgagtttcatcatacctatgacttaagaatgagttgatttgagtcatttgtatacgattttaattaaattattgggttaaaatatttaaatttgtatgctatttattaaatccaatatttatataagctaaaattcttattaattagaatactgaaaacattacttataaattaaatattgtcagatgctgcgactaagtgaggtggtggaaagatgtcaagagttgaactctaatttttgaaagaataacaatgacactcggtacttattcaactctcttgttatgcacgaaacatatatttaataataaattcacgcgcgtatttataaaattatatgagaattttttgtataaaaatttaaacacataaattatattaaattaaaatgttatggtaattttaaaatatgaatgataaaatgattcaattattatactttaatttttaaataaaaattgatttttataatatttaaagtttataaataatattttgaataattttacatataaattaattaaattaaatgcaaaaaactgagattaaatatttcttaaaactaattaattaatatatgaatcactttatattagtaattgcgagctgcttgtctcttctctcccaacggctcccgccattcaaagtttggagataattaaaagcaataaagtagcactgcattcgttacctctcttggtagagactatagaagtagaaggaagctcaagggtttttattttaaaaaatatataaaaaatgaatttaataatttttttaaattaaaaaataataggagcaaagagaagttgggttccctaaccccgacttctctctgcaagctaaaaaggagtgttgtttaggaaacaattttgaggcaggtgtattttgaaaaaaattgaggagagagcaagtgtagtggagtaaaaaaatcctataagattttgtttgatactaaaaagaaaaaaataattgtgatgagaaaaaataagttagaggataaatatcttcaacacttaaacaaacaaataaaaaagtttttctagaaagttcacttaaatctattttcactattgataaaaatttatacctgttgatttaaaataaaattatattttataaaaattatatttattaaatatgataggagaaaaatattttttacatatagtaaaatattttcatttgctggacttaaattttctttatctctcattttagtattgttgtttgagatgatctcactaaatatattttacttgactaataataaaaattttatatagataagattcaaaggataatcaccaaccaaaaatttttatggaagtatttatcaaataattacaatagatatataacataaaaaaagagttgaattgaataataatttttcatgccaaattactttaatcactctatattattattattattatcattattataacatcttcacaatattctttattttattagtatctattatttattttattaattttatttaataaaaaatcacaaacttttctttttgcacacatctttaacgtacatataaagatattcaaatcttgaattcattaatattatgtttttagggatcaattagcatgtgtcctttctttaattctttctcttttaatttgttcaacattttttttgtcttaataattttttaatctcatttttttattttcctcctaacaaaatttattctatatataagaattaataaaaatttaaatcttttaccacttgattaaaaaacataaatcattatcaattattttaaatttataaaatcatgattcagtattagatctttataaaataccatatctctatgacaattttaatgattaggttgaaatataaactaacacgaatttaagtaaatatttcactatttactttcacattgaaaaattgattttaaattttaactttagaaaaaaaattctaagttgaggatctttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagataatggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttcagtgtttggggctctgacaagttgaagtcgttgcctgatgagatgagtactcttctcccaaagttagaagatctcaccatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttagccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcataatggaatggatagcatttgatctttaataaatttttgctttgtgataggttcctaatatttaaaaagttttgtttgaaatacttatcattagtcaaaatccgttatttgctcacacgatcgttaaccagccacacagacatgtcatgtgtgatttttgtctgactgagattaggactaatgataagaaactatagtcaaaatcctttggacatcaaagaatcattcttcagcaaataacggattttgactaatgataagaaactatagtcaaaatcccttgggcatcaaaaaatcactcttcagcattcctctacgttttcacacaacccactatagtttcttctatacctttcttatggatttgtcactatgacttcgtcactcgtaaagatccaaggtgaagaggtcctcaccaacgatttttaggaccttgcaatcaattttgcattttcaaatcaaaccaagccaattcccaactcaagaaattcacatggataaggtttctaagagaacacatcaaaatagtttcatgggtagaagaaggtcaacaaaaccttaccctaaaatgtgattccgctcggtccattgaatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcagccaccactggtgctgccagtcgtgccactgctcgtgccagcgccagctaccaccagtaacttccttcaactctcaaacctcacttctctcccagtctctctctcacacttggccctccaacccacttgtgtgtcgtaggtgaagagaaggaaatgatgaaaacaaagaggagggttttctttggggaaggggggtccatgagtgatttttgagagaaggagatttgttgttgccatggggagccatggttcaagagaagaaaaaaagaaaatgggttagaattattgttgtgttgctgccatggggtttcaagggaggtttggggggttttggagacataatagcggtggtgtggagctagtggaggagttggttgaggactggtgggggtggtttggaggattcggggacttaatgatgtcgtttttttacttttttctataaaaaaataaaaaatcttacgtgatcggttaacgatcacatatgaagataatggatttcgactaacggtaggaacttcggacaaagctttttaaatattagggacccatcataaagcaaaaatttattagggaccaaatgtaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatatattttctgttcgagattgattgaaattatcttatttgcttaacatattaaaatgcgtcatttttaatgatattattggtctatagtttttatgtaatacatttaataatgtttagaaatatttgtatataaataacttttatctattatttcaccagagcctatgaaatgtaagcacaggtttgttaatgagtagcacaacatggacagtttgtcaaaggcccaatagcatctttaatgggattcttgaactcaagaactctatccactagatctactattattcttattaagagttttttaagatggagattgggttctaggaaaagaactcctattttttcaaaaatattattttttcttgtgctagtaaaatctaataatccgaattggattctactattagaataaaaaatgatagaagttcgtgcatcctatataacatcatgggactcacaaaaaataatccaagaacctaaaatggattctttgaccaaaaatgttctaagaatctcaatattttcccacttaagaaatataactatcaaatcaatataatatgaaatgagttcaatctttattgattcacttgacgcaagctatatgcacaactgacataatagattttaattctaaataacatgcaataaaaatataacaaacctgttccggaaaaagcctcctcaaaaagaagcacattcggtccccccacaatttttacaagtcggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcgggaacataatccaatacattccaatctgaaccaaaacaaaacctaaaaccaaactactaactgatctataattttttatacatcataaaactaaaaaaacaaagcaaactaagcacataatcttacaatcccttctgaatttactaaaagagacacagatagttgaggtgggaaatgttgccaaaccagaaatgaattatcacgctccaaattaactttggaagccaacctgcacatacgtgtcttcatgaagagtatgctgaagctggatcctccaatcttgctccagcagtgagctgattaagttgatgagggtagcatacgtgaggatgaaacttgttggttaattacttaatttcttcctaggacgagtctaagaatcagactcaaactaatagaagcctagattcaaggcatgacagagaccataaaagatggcatggagttcagccttgagattggtagacactccacacgatcttgatttcatattttttttcttaaaataactacatacatattaagtagcatggttttaaattatgattgtgattactttaaggtgagtcataaaatctttttatatattgcagctaatcactggaaagtatggctgatgtggttacaattaggagtcttcttaaagcattaatattttttaacttaacaaatataattaaagagaagtaactaataagataatgatctaaaattcttgtattgattggaaatagcgtaaaaagatgtttcaaatataatgatacaaactctttaaatgcaaatggttacatgcacaaagcacgtgtatatatatgtattcatacatacatacatatatatatatatatatatatatatatatatatatatatatatatatatatatatatatatatatatatatatatatatatatatatatatatatatatgtatatatatacatatatatatatatatatatatatatatatatatatatatatatatatatatatatatatatatatatatatatttgaatatatctacgtacattcatatatgtatgtatatgcaaacatatatacatctggatagagagaggatcagaatagcaggacaaagacaaacttgtatttgttgcttccatactagaattgcattttcttatatcaactgtggaagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaaccaagctttgtcacattgaccaaaaaaaccaaggtgacattgaccaaaaaatagtcctgacaagatgttggtaaaaaaatataatcggttaatatcgatcacaaacatcattgactaaggttgacaaaaaaaattttaaccgacattgataaaaaaataacttcgaccaatgtcgatcaaaagaaacataaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccattttttatgtatgtaatacggtaacacatgtacctcttgcacagattggggagaaattgcaactttttttttacattttgccttaaaaaaagtgttcatatttataaaaataattttctatttaacttggatattttttcttatactactacactaaggtatatacaacctaattaaggcgtgtttcttaatttggagactggtgcttgattgattgactaccaacgaaggataatctaaaaaggagaaacaccatttataatcctcatgagtgcttatgtcccttttgccttgaggtagatgagtcggcatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaattaagaaggaggcagatgtatggagggcggtgtgggcatcagaaattttggggtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgcgcatcaatgttgcatggctttagacatgattttaaattgcaattatgattgcgttgcttgcaacgaacctaaaaatcttacattgtggataattatggaaaaatacaaactgatgtgatcataattataattgtgatgtgattacagagtcaaaatacattagcgttatgactgcaattatggttgctgactacaatttaaaaccatgactttgggtgtaatggtccatgttcgatgctagctatctttgtcgagatagaaatataatctaaccatggaatttgctttctttctactgtcactggtgtatatgtttttggatcttaggtacttttggtaccatttaatacaaatcattttgttggaaaaaaaactacggtagcctacatgcaatatacaaaataaaattgaattactatatattatcataaatagtagagtataagaagtaaagaaaattctaaagataaacatgaatttaaaaacatatgaaactaatatatatatatatatatatatatatatataataataataataataagagattgttttaactatatatataacatatttaattagcttaatagaaatgcgaaagtacaataaaaaagcaaaaacataataggcgtgacaaatcggttgctaatatacaataaagacaacaaagtttgaaactaaaaccttatccagactatccaaataaccctaattaatcatgcaaaaattagaacagaagaaatttaataactatagcaacagtaacagcagcagctatagctaatgccgcgatcaccgaatcggaaaacttttcatcattgaagtattctatttcactaaccctaagcaagatctcaagttgatcgcgtgcaataagagctagcatttcaatattgaaaaacctctcaattgagtctgcaagatctttaattttagttatccacggtaagaattattagccacaaaattgtatttccctatttttgaacacttgtaaacaacctctttgctcttcctcaatagttgtatcagtggctcaagttcctgctgtgaacggcccaacatattcctgtacttacctatctcctgccatgtttaccgctacatattttctagaatgttatttgaatttcattaaaaatcataagaagcaagtttgaatttttcagtgaaatttttacttaggtttagttagaaaaccctatttaaaagctatattgttttgcttatcgaaacaaaaccaattagttcggtttgaatttcttagttaataaatcaattttatatgattttttatacaaaatattaaactcaatttactaaataagatttatatcaaattcatgaaggtaaaagtaatatttttatcttttaatgtaaggcttggtttcacttttgtcctttaacttttttttatttgatttatttcagttatcatttaatatttatgggttcttccttaaggaatcttgattttcctatagttttaattgttcttcggttatttattccgaaattgagaggggatcatcacctccaaagatttcctcgctcccattaacaaaaatgtctaaacaattaccttccttctaaaaaatttgtaaagtacctccactaattaaactcaacatattctcccatacttcattttctttgaaaacaatgttgtctaattcaagacgcttcgatataaaatatttagtcgctagaacgagagaaaaaaaattgaataaaaagaagggattttttttttcttcttaacgtacttcatgctacttatttgctggcaatcattattaatatatattatcttatatgagacaattttgaacatttaaatgttaattttgtaagtatcttggtagtatccttttctgataaggaatagatattattttgagattatattatgatgatgaattgtctcataaaaacacgaggcaagcacttgaaaggaacaaattctctaatttcttagtgggtagtgggagagaggaagtaaacttgcttcaataggcaaatgacgcatgacgcactctttataggagaagcacacttttctaaggtgcttaccataaaaagcattttgagaggctttgaacttgtctcgggcctcaaaatgaatttccatcaaagcttttgtggtgccttgggagtggatattgataccttgatgaattatgcaagcttgcttatttacttgagacagactatatatgcacaactgacaaaatagactttaattctaaatagcaataaaaagatatataataaacctgtttgaaaacggaggctacttcaatctagtacggtagttgacttactaagtacgaaacaacaaattaatgagactgctgactactgatttcatagaaagatttaggaagatgaggagtaagaaatgtatggtaaagcttctaggagtagaatatgttactatgtcttaaagtaaaaaaatatttatgtttaaaagatgaattatgattcataattattttaattaaatataaataataaaagttatatataatatattattggatcataatttataattttatgtttgtattttcagtcaatacatttataaaacaatttagcataacatttatgaactaaatttaaaacctttatttaatattttaagattctttcattagaaacaagttccggtataggagttggtatcctttcaaatgatataaagcaatagatttaaattttatattctattttattgtgtcaaaataatgtattaaattctttggtaagagacactataattttaagttattaagttgataattaattaaacatgattttaaatacttacatatttattcacttataactataaagatttagtaagagcataaataaaaaatgttgttataatatataattttaaatttaatataataaaaatgtgttagcaaaatagaaatataaacataaagcgtgacaacacatgtttttagttaataataataataatattaattacaaatattaaataggttttgacaaaatcatacctggcgcaaatatgcagtttagtgacggaattaatttgtgattcatgcaatacaatttgtaccaatcatcatcatcatcataatctctttttcgttttatttatcaatgttgctacttagtacgaaaattatttgcacaaaatacaaacagaatgatgctatctgttatgaaaagtaaatccacacagaattacacgaaacatagaatggacggttatgattttataaaatgaatatcgattaaatttaaatgttatggtaattttaaaatatgaatgataaaatgattcaattattatactttagtttgtaaataaaaattgatttttataatatttaaagtttataaataatattttgaataattttaaaaataaattaattaaattaaatgcaaaaaactgaaattaaatattgcttaaaactaattaattattattatatcatctgctccattataattgttgtgtaaaaaataataattctaaaataatttttatttttattttttaatgtaaaattaattatgtttttttacttatatttcttatatatgaatgatgaactacaaaatttaaaaataaattattgatgatataaagttaattttataaaattattttttatttttttatttatataaaataatgtatgatgataattattttcagaagaaaagcaacacttttctaagataaattgttatagatgtttaatattatattttgcttgtaagacaaaaacatactaactactaaattatctaatttatgtatatttttagtcctttgcataatcgggcgataacttatcatatgaaagaatactgatgatgataaatactttttgaagaataataatttttatgaaatatttgaattagttttacattaagagtttctaatgatcttaaaatgattaaatgtattatattatatttagtaatatacttaaaaatttaaatattgttgtaattttaaaatatgaaaggataaaataattgaattattttacaatggtatttcaaacaaaaataaatagttatactttttttttataatactagtatatgtataaaatagaagaagatagataaataatacaagttatatccaattactacaagtacgcaccgatcaatttcaataaaaaaaaaaaacaaggtgtgagtgaagtcaacaattaagatagaaatgaagttggaagaatcatcgattttaagattgcattatatgctaataattgggctgactatatatacccaacaattaatgttgttatcgttgttgtgcttgtctagtgaatgatggcagatgttgtatttcaaggtatgggaactgcgtggcaatttctgaacgtgattatggtcataaaagacaaagttacgttcaaaacagcattggaaaacctccaatccattctaatacgcagcttgtttctgattgttccaaagtccacagcttaaattttgtgggccaggcatcgttacaatgttaaactaaaggcatttacaaagtcatttcggaatatttactccacggtcatgttagctcagattgcaagagatcaaaaagagaaccgtaggagtcaaatactacttgcctacaataatcctgctcagtctcataagattctaagtattgttgatatatattaatattaagggtctatctggataaatgtatttagaagtactactaaaaaaatccatctcaaagcagaaaacgcccttattagcttcacagcaaagacagaaatccacgtcaaaaacattaacaacgtgttttcaattgcctccccagggtcgaagcacgttttctcaacaaccctaagcaatgtctcctctgatctcttgccatctgagcttgcatgtcgatggcaaatagtttcccgagctcgtcgaaaaaccggtccagtttgtccttgtaacaagccctagtcacaaagtgtagccaccggatttttgaacactcgaaaacaagctgtgtcccctcctccatctttctgataaacgattgggagttcctccttcggaagctgcaactcgttgtttttctgttctatctccttgatcaccggagatatagctactagagtggatattggaggtgcaccaaagatgatttgaagcaaaccgttttgtttttaagttccaaaacggttcccagcaactcgttgaacacagctcccactgttgcttctattagtagtgccatgatattcacaacagaaacacgcacccacaaggatgaaaacaagatgaagaaataaacctctctttataatatatagagtcaggttaaacgtaatgttaaaaaggaagtttcttggaactccatttctatcctgttgactttacgaacttgtagctaggtatacttgtttgtattatttaccgacttgaacatattttaattatttatttaattaactgaatagttataatttccttaatagatgcgagatgccaaatcttgttccaccctccaaccccaaggataattaatagttaagtgtgaaatagtatgtgtgtgtctatctatatatatattataaaattttttatacaattatctaattataacatattatttatgtgagaaatttattaattttttaaataattcaaatgataatttataatcagatgaccgtgtcaaattattttataccatcaatgaataaacattaatctctctctctctctctctctctctatatatatatataaattctaatcaaggttggttgaaattatcttacactaaaactaccattattcttattcaagagtatttcatgatgaaggttggattttaggagaaaaattcctaaaaattcctttttttttttgtgcaagtaaaatctaagaattcaaattgaattttatcattggagcaaaaaatgatagaagttgttgcattctatatagcatcatatgacccataaaaaataatccaagaatccaaaaaggattctttaaccaaagatgctctaagaatctcaatattttctcacttaagaaacataactatcaaattaatatactatgaaacgagtttaatctttagtgatttacttgagacaaactatatgcactactggcataatagactttaattctaaagaacaatacaaagacaacaaacatgttccggaaaaaagcttcctcaaaatggaggctacttcaatttagaacactcacgtgaagtgtattgtataacatgtctccttaggtcagaatgagagctttttattcgtgcttgaagcacgcccccttcaatttttacaagtcgaggtctttatgttgtatcaaaatgttcaatcatatccagctaatgttgtcgtgcaattaactttatgatagttgtcccttcatgatgactaactgtcgtaccataaacaattcattaatcccttacttttgctagcgagaaaattgttgctgcagtccactgtaatatcatttgttgcaaaaaattttgcaacgatatttaatgtcactaccactcttaacgctttcgcaacaaaaacttctactatttgataactacgaaaattaggcttaattgatagtcaaatttaactaaaaatgattagaatttctttattttattattatttttaatagaataatgaggattttaatatcattttaattcttctttcaagtttttaatttctcctcctcagtaatctagattccataagatacttcttgaagtgcagctatgatttttttttttttgtattttaccattcttttcttaaaattatcatacataattatatatgctatatacttgttgttagggaagaagataaaagttggttttcgaggatcagggcctccactgagaaaaggataagggaaggaacagttgtatattccattgattgatgctgttattacataatattatttatactgatttctcaataatcaaatttgtctttttgtgctacagaatatcagcaaatggttaagtttgtctacccctacagtacagtggcggattcaagatcctaagtcagttggtacaaattataaaaaataaaatcagtgggttcaattatataaatatagatgaaataaaatataaaaatataagattttatttacaaatttggtgaattttaaaaaatgaggggatgcaagtgcacaccctcagatggctgtaggtccgtcattgcttccagatatggtgcacctgcttgcaatccttgagctaagtgggccttgtaattgctctcttggtcttgttttctaattgcacccttttctgttgcttgcttgctgcattctcatcctctgtttctgcaactggttcctttgctacgctatcacttgtggtgccgtttttggcttttccagtcttcccaagttcccactgattcaaattccaaaagttctgcaaataaaattgaagaagaagctagaggtgggaaatacttaagtcattctcttgaaaaagttgcagcaatgatatgcaacaaaatatcactataccgagtcaaggtaattattgtgttcacatgaacatttctcccatgaaaatatatattttctgactttgtaatctctttatagtatgcatggaaaaataattttctgattttttttctctgtagtgttatatattatttttaatcacattttcttatttatttagtttgtttctgatttgacatcatgtgaatttggagatttgggttagaaatatttttggaattttcctggttagaacttgataggtccataatgaaggtatataaaaggatagggaaaagagggagagcggaatagaaaaagaaaggacaaatgggcctcaaaaacaagacatgcttgtgtatgacagcagaaagaatcagcagtacaagttgcactagctgaagtggaaaaggaacataggttgacataatggaatggatagcttgtaaggagagtgtacgtagaggctgagaataagttcttccttaagaaagggagtgggtctgggtttgttttttcctaattaccattctcaacatctggcttgtatccgccactccccttctctctgagttctatttttcatacttggaagcctattttttttaatataaatataaaattatggggatatctacctgtcaaaacttaatataatatattagtatctattatttatttattttattgattttatttagtaaaaatcacccacttttctttccgcatacatctttgacatatatgtaaggacattgaaatctttaattcattaatatatgtttttaggaataaattaacatgtgttctttctttaattctatgcgtatgggttaaccaatattcaaactctagaccatttagttaaaaaatacaagtcattactatttgtgtcaatcattattggtacactgcacaagtttaaaatctagttagatttgtaaagaaatgttatgttacatttcaaatgacttctgactttctttagtagctaaaaaacttgtttaactatttgataaacaagttttttcaataatttttaacattttttaaaacgttacttaaattaatatttttaaaaatactagtttctaacattttatatttttttcttattttatctttaatatataaacttaaatcttgaattagttagatacaagactatatccaatcccacttaactaacctcaagaaattagatgtcttatataattattaaatttatttaatacacgtctttcattttgtaatgataaaagatttactgataataatgcattccttttatagtattaattattttatttctattatgacattattttcttactctaatttttaaatatttttacttcataataaatataagaaatgtaatatcaaatattatattaaaattaaaataattttaatacgaataaaacaattaatcatatttctaatttatgcgttatgtttttaagctgaaaaataaaattaactgtaaagatttgggtttagttaaatttattcgtaattgactttagaaggagtaaattgaaatacacttttaaattaatatttgagtttctctatcaaaaaaggctatttgagttttatatttttattccgacgtcaaattctttgatatgtatagactatatttgagatacttttcgctttgaatttctatcacgctctgagaaatcaaatatatatatatttctcttgatcttaactttaaagtttaaagtgatatgagatttttacacatactaaaacaattttttctcaaataatgcatccattgatatccttgtctttgggtttggatccaagagtttcgacagcaatctgcgtacatctggtgcaatccagttaggaaatttgaactctcccctgccaatagaacatacaagatcataactccttctgtttatcacttccggagcagcataggcaggggcaccacatgtagtggtggagtaatccatttatattcccattttcatccagtagaagattttctggtttcagatcacgatggcacacacctcggctatggcagtagtcaacagcgctgatcaattgctgaaattatctcctagcatcatcctgcttgagctttcctttggataccttattgaagagctcaccaccttttacatactccataacaaagtaaattttggttttgctggccattacctcgtaaagctcaaccacatgtggatgcctggttagcctcatcgctgaaatttcgcgcttaatctgatcaatcatcccaactttcagaatcttctccttgtcagtaatcttaatggccacactcatgccagttatgatgttcctagcatggtagacttttgcaaaggttgaacaaggatagctcagatggaggcacggactcatcaacctcggtgaaggaattcttaactgtcaagcacatctttcaccattccctgattttggtgatgacactagagaacaatgaagaatatggacttcttggaaagtttgaagaataattaaggaatgatgcagcacctggttagccttccaattacccagcagcagaatatacaatgaaagacacacctgaaagaaagatgaacaaatttaataagttgggatcattgtcagagaatataatctcctgaataaaattcttgaaacttctacaaacataaccagcataacaatttttataacttgtttctgatgtcatttttgaacaatcccaaaaccataaggcattaggtgagttttgatcatatttaaacaggactggattaaaaaacaaagtatttagcacatcaattacatttctctcaggtagtctagtcgtttttagagttcttataaataaacgattcatgaccaagaagaacaacacaagactaaacaagtatgacagaaatgtaagattgtcaaaaatcaagaataaatcgaaaccagagatggccacacattatgcagaagaaataaaatttaatcaaacaatcaatcagcagatggcagaaagcacactaatacaacaaaatacatcaataatgaacttgagattcataaaaaaggagcatgcaaacaagtgagacctgcattctgttttgaattacatagacaaatcaagtcattcacactcatctgcccaaattaatcgtctaaagttgggagagtttaatgacactcgagaagaaaatgaaaattcagtaaggtttcaaataagcaagtataaatataactgagttgccaccgttttcagatgaatgtggttccactttccattacaatcgttaccgtttggcagtctatctaccaattttcatgcttgggtcacatgcactaagttattgtcaatacatattggcaacaaattaaaattttccagatgaaaaaaaaaggaaaaaatttacaaatttgccgataagagaaaaaggcaaataaacacaaacacccctctcaccaagagagagcttaactcatgaaaataacaaccatccacctataccagaatttggttttaaaatatcataattttgtactgtttatttttaaacatgttattatttgtaaaaattgaccaaaggtgcacttagatcttctcatgctacacaaaaatcaagtttaataaacattaagaaatatttgttacatttaataagggagattttcataataaaaaaaattctgaatttcaataaaaatacatttgatgatctattttttgtagtataaaatctttgtataacattagaaattatgaaatgtaaagtcataaaaaggaatattgatatactctatattgtttctaagttttttactatccactttgtagtagtattgaataagtaaaattctatcaaaatctttcacacaaataaaatcaggtgaaatctcaatattatgattgggcaagatttccctcatgaatgatagaatctgaattttatttgattcttgcttgctggttgattttttcttaagaatttaacaaatatatcttttatatatatatatatatatatatatatatatatatatatatatatatatatatatagattttaatgcattaatatacttagattagatacattaaatttcaaatttctgtaacaacctttgtgaattataaggaaagtctggtcaactaaataagctaatttacactcatgcatacaatcgcttcacttgaacttaactcaatcgtcatcatcattattatagtgagttaatagaaatgcaagattctcattactaaaaaaaaatagtcattactaaaaaaaatagtcattccataaaaaaatagctataagaggtcttgttaataaatattcttaaatactaagaaaacttaaaaatattaaataaaaatataatattagtatattaaaattgtttgaaatttaatttattattcaaacaatttgcttttttaaaaatcttaacaatttcacttgttacaatgtgacaaaacattcaaggaagaaaaaacaaagttaacttatatgtgggagtgagaaataggacaacaaatgaggctataaaagtaatatattgttgataaatagaaaaaataagttatataataaaattgtaaaacaaatttaaaacttcattcaataatattttatcatctataataattatgataattatcttaaaaatcatattaatgatgatatatgagtgaatgataatataaaattaatttatacttaatgcatgagtttaaattatagaaatattcttaaatattaaataaaaatataataatagtatattaaaattgttaaaaatactgtatagtttatcgttcaaacttttggtcctttattaaatcttagtaacagctcccttgttacaaagtgacaaaatcttttgggtatgagattggtgagaattagggacaatgaaaatgatggcatgccaaacatcgctaaattgacctaatggggttagttttacaaactaattcccagaataggtctgttttaaaactattttcaagggggtttcttttttacgtagattcagccatgcatgcatgtatatcgccagcatgcatgtatatcgtcagcatgcatggcgaaatacgcctgcactggacatgtggctattccgccagtgtcactggcgagatagctggcacagtttttgccactttgactggagatttcggtgcagagggcgcaggcaaggtgcaaagggcacaggataacagtagggcagtagggttcaggctaagttggttttgcaatcagtgttggcgaaacaaggagcatatatcgccaatggtattgacaaaataggtgtgttgtgccctttaagtagcaacttcatgttgatgctttcgtgctgatgctttgtgcctttaaaaatttctgagtgttctaagtgtttttaaagtttctctcaatcagtaatttctcttctctggcatcgtttttatttatttgaagtaattattttgagtctggaataaaatttgagtttcgactggcatcatttttatttattaatttctttggcatttttttatttatttaaagtaattattttgagtttggaataaaatttgagtttcgagtattttttgtaattagatttgtttattttgaagttattaatgttaagattaattatttataataacaacttctttaatgatttgttctgcctttaaaatgtctactttcaaaggtttccgttctgcctttaaaatttttactttcaaagcgttcaagttttttaagtttctgcatcatataattaattttttgttagaataaatttttaatctaaagtttgagtgtagtatttttttaattatatttacttattttgaagttattagttttaagattaattatttataatagcaacttagttgatggtttgatgtgcctttaaaatttctactttgaaagcgtacaagttttttaagtttttggcatgatatttatttgaagtaattaattttttattagaataaagttttaatttgaagttttagtaacaaggttttttgttattagaatacccaaaataatttaaaataacaaaacaaaaatttaaacaatatatattccaaattcatacaaactaacataccatatatttgaataataacttaaaatacctaaaataaatataacatccaaactttataatacctaaaactaaaacaaataatttaattatgaccaacagaaaaaataaaacacaaaattttttaactacattccaagtttgaaaaaaccaaatatgggcgggagaacatgcagctcacaagctttttgtcaccaccaaagcgtaacgtaacaacaccaaaccactactaaaaataaaggccttgtacatcggttataacgacctttctacatcggttatgacgcgtggtggtaacccggggtcgttgaatcacaacatcggttttatgaccgtctttgaaggccggcttttctacatcggttgtctagctacaaccgatgtagaatgggtaactttctgcagcggttctcaggctgaaacgatgttgaaagggtagatttctacatcggttatcagtcaaccgatgtagaaaatgaaaggtttctacatcagttatagttcaaccgatgtagaatgactagatatggtaacgttgctacatcggttatcaatcaatcgatgtagaaaatgaaagctttttacatcgtttatcgtaaaaccgatgtagtatggggagattttcaacattaccttgtattggaggtatattgatcctttcctttagcaataaaaaatcgaacacgatgtcccaactatacttaattattcaattcaagaacctgtgattacaacaaaaaattgattttcaggttcaagtcataacaactgagtataactaagagttttctagaacttattagtatggtactgtatgacatggatgacaggatgcgatttctcatcacagtataaactaaaaattcttatgcatgtgtagaggctaccacttaatgttttctcatatggctactacaagtcacaattttcttgtgcaatgactaaaatttaaaataggaactataaggcacaaagaaatagtttaaccaacgaatttcttgtaaacatagacaaaagtcagaatggaaggacctcaaaatgacctggcaatagcaattactaatttgataacttataatatcatacattgggtacaaaatgaaaaaataaaatgttataaacatataatataaagaaaatgataacttaatcatgtaatcattttgttttcttctaaatttcaagaaaaatattgtaagtagtattccaagtggaagcaataccaatcaagcactggacaatttgaatctctgtcaagaaaaaatgctactgtcttatggtatttcaagtagagatgacttctagcgtgtcacaggaaataaaaaccatctattacgaaagatagatgtagaaaattaaaatgaaaatagtactgtatgcatcaatcacaggaaataaaaaacaggcaagaccctcgatattgttcatctaacacgtgcaaaatatattattatactgtatgaagtattttgatctggtagtataattagggtcagtgcttgagcagttcagaacagagcgctgcagtgcaataaccaagacaacaaggactgactttttttggttgcacaataagtactgtctgacactatgattgccacaataaatagtttaagagcaaattagtaataaatgtcagtttgatttaaacaatagtattacactcctgggctcagtgggcttcatgcatcgagccaagtccagcgaacgtgtaacacgctccaaattttatttaataaatttgttactatttaatttttaagtattattttgtgcaagttgaagcttcctcagttccatagcactactatagcagcaatgcttaactagacactcagaagttaaaatagaaacctgaactattaagtaataaaaaccagttaactgttataaacaccttcagagtatatcagtatattccatatacctaggcttatttttttggaggcaagaagtttctggtactctgctgcctctgattttgctttggcaattctcttcttatctgcaatccttgccctctttctttggagggtcaggggagtgaccagccgttgtatcttaggacctttgctcacctttttccctacaaccaaacatatgcaactcagactagaaatcatcacaatcatgtccaaaaataatctccttcaatgggtcctacccatcaaacaacagcataaatatgcaaaacaaagttttcaaatttgaacgagaagtgatagatcataggagataacctcttacgatacatgtactaattttttaagattatcaaaaagaatgacctgaagaaaacacatttttatcagaagtcctatttttgctacacacacaactctgaatggataatttagataaattcttactgcaaacaaaatatatatacaggaccacagataaatttcaaaagaaattttcaaaaaccagataagctctgttaatgtggtcaccttaaaaaaaacaatccattattaaaaaaaaaaaacttacataacatcacgtaaatttatatatttcatagaatgatataattttttttgtctctatcaattatatgaagctctataagcttgttcaatggtaatagaggcaattagaaggtaagacatgcatgtgtactttgtgagaagttaaccaactaattcatttgttgtgactttgttaaaaaaaataaaaattgtgaagaacggcttctctgccaacacaaccaactttagtcaattagggtgtgttgtttggagaaaaagaggataaaagaaagtagaaatcaacaaagtgagattcacatttctacactttagttttaaatttttatctcactttaattttttttttcatttctttccactaacagacccttaaaaaattgaaaaaataatgtggacaatttagtcaactcactaacactattataagcaagtgggttttaaattttgaaaagcattacgcaataaaaaaaattaaatgttaaactacaaatcatgaacaaaatcatatatgggatttactagatgagaaaatccattgtttaatttccttgaaaaggaattattactcgggtttttttttctaagcaattaagcaaagagatatcattaataaaaaagctagaagactgtacaagatttacctaggccaagtcataagacaacatacaaagtttagaagcaaatacatcagaacataaaaaatgcagtaaaaaccaggatcatcctttaccagtaaaaaccaggttctcatccaaacttggccttgttcctctctttctcttttcgtgtacccgttgctaaccacgaagcttgatgaccatgacatgaccaaaaataaaatatatcagaaaatgataaggtcgaataatacgttaaagggcaaggtagatcagcagtcgtaaaaagtactttttttagtagtggaagtctatagttgtatacctctcagagcaaaactactttctattaccatcaagcgcttgtttctttacaaattacataactaaacttgcccctctttatattcattagtattttcaaatttcatcctttcatcttttgacttttaatgcttctttttcctgttattaacattgcttgttacatgtttttttagttaagggtagtggattgattaataagttaaatagttgaatagttactaaaaagttgtatagatactaaacttgtatagatagaacatgtatctttgggcttattttaactaattacatttagttgattttttttcttctcatttattattgtcttttttggcttaatcgtgtttgttaacagttgtggtgtgaagtattaatgaggatgggatttgaagcttctttacacggtttggttttgtattttgcagacaaattcattaccaaggcaaggaccaaacacaggtcttgcactccagctaccaaacaatgcacctgcctggcaaggtcctaacacaggacttgcaattcagccctcaatctggtgtacaaaaacttgtaatacatttttgtttccagggcgtatttcaatctgtttgtaagatttttaagatactcatatctgtcatacacaaattctcgtgtagttgtttgagtatataatgaaagtgttaaaaagtttcatctattacatatttgtattaatggagggaagaagagaattaggttttatgtataggataggataggatagaagtatatgtagaagttctttttggttttactatatcaaattagatgttttttgtgaattgtgatgaatgttgtcatgacttaaggcttaagcacagcaggattggtcaataacagtagttcattatgtggaaaaaccccgaggcttaattaccacattaacatcttattttgctcaatgtaagattcacaacattgctactccctttaagaaacatgttcatggtggcttcgctctatttccccttacattggcagactctcaaataataattcagtacattgcatcttactctagcctataattaggtatttcagcagctaaactctgaattaccacccatggtgccttcacttggttccccttacattggtgggttgacacaccaatgtatgcagtagattgcatatcataacagcagaccaataagttgattctcattcattctctattgtcatcatactgtcaatttgggtctgcaaaaatgtctacccaaatacacaaaatcttacacaattacaagcttgaggaattgacttcactaaattaaggcacccagcaaaagacaattggtgagccttccaattagagaggtgttgattcactttatttaaaataaattgaaaggaattcctctacactttttttatgaaaattgggattcccaaatactctaccaggtcatcagtatgttgatacctcattctctgccaaatagcctgctttcactgccatcccacattattagaaaaataaatacgggtattatcattactaaccttttggcttgagctcttagaaaataggtcaataatatgaaccatcatcttcacttgttcctcactagcttccgcataaaggagaaggttatcaactaacgccagatgagacaatttacgtgttcttttaactatctgaataggcttccactgttttgcatcaatagcaatttgaattaagtgaatgatgaggacatgaccaagagcaagggcaaggatccacttgaaggacttggaggacatatgacaagggctagagcaaggaaagccaaggaagctcttcaacaagtactatccatactatttgaatacaagcccaagtttcaaggagaaaagtccaaggttgtgagttgtatcatggcccaaatggaggaggactaaatggcaccactttgtctcaattttagagtgtttagtttgtctaaataatggctcaatccttgtaaagttggttgaccataaatatgttttgggttaatcaactaaaagagctttagtttggtttagttcaagttgtaataagggcccaattggcaacctaggcatcagccttttgggagaccaaatggtggctagcttgatggctgttgggggtgacttttggttgccacaattttagttacacttagccattaagttcttttaattccctaggttagtggcattaagttctttaattctaggttagtggatcattactaaaatctgatgtaaagcttttatataagctgaaccattttatcaataaacacaagttgagttttattcagaaaaatagagtttatctcttttatcttagtgagagtgattctcctaagttcttgagtgattcaagaacaccctggctatatcaaaggactttcacaatctttgtgtgtttccctcgccggaaagagtgattctttccttcctttcatcttcaaccttgttctttcaaaccacaattccaaaaaatccacttctgcccataattatctcgtggccataactcctgttttacgcgctcaaattaagtgattcttgagcctaaattgaatttcaaaacgagatctttcacctcgttttggaatcacctcatttggagccctgtatcttgagttattgccatttctatatttctgtccaaccaccacttaacctacgttttatcatctcattcttccattttatgccaagaaccaccttattaaggcccacgaaattagccaccgctcaacccttaaatcttgcaaattttccatcctttccttaatcaatttccgcattttccatcaaggtttaatcctagacaatccttagtcagcctttgtgcaatgaaggttcatatcatttggtatcagagccaagttctaggatcaacacttcctttgctggaaatattgggtaacatcccttctttattctctttgccatttatattaccttcttattcatatttttttaggctgaaccattgcaaaagttaagccttttgatctctttgttatatatatattaaaaaagcagaaattcgtataagcaaaattaaaaacaaaaattgggctgaatggttcatgcctgaagaacttaaaaaatatatatatttaaggtaatatattggtagcatgaaggattgttacttgaattcctaaattctgaattttatttccttcatttgtgcctaaaaacattgttagcctttttcttggttaaccttttccttgtctctctagccttaccttacacatattggtgaattgttctttgttgtggccataatctcttgaattgcctaataactcaaggggaattagagtggtaaaaggcaagagtgtttcattagagaaaagccataattgtgtgatacacttgagtgggtgaggtattcaaacaacaactataattgtattgttatgtttgatttgtttgtttgagatgacaggaacaaatcctaatgatgaagtggggctttcgcaattccaaatgcaagctttgatgcaacatttggagaggttaatgaaacaacgagatgatgcactccatgagaggttggatcaaatggagaatagagatcataatgaagaagaaaggaggagaagagggaatgatggtgttcctagacaaaaccgaattgatggtattaaactcaacattcctcccattaaaggaaagaatgatctggaggcttacttggagtgggagataaaaatagagcatgttttctcatgcaacaactatgaggaggaccaaaaggtgaagcttgccgccacggagttttccgactatgctcttgtgtggtggaacaagcaatggttgatacatgggtggagatgaaaatgatcatgacgaagcggtatgtgccggctagttactcaagggatttgaaattcaagctccaaaaactaacccaaggcaacaagggggttggggagtatttcaagtgtcataccctaatttcgtccgggaacctttgctcgatgacatgcgaccattctttggtccttgtgaggtgcttggcacccatcattaggcaatttatgaaattccaggacatgccgaaaaaccaaaaaaaatattgatgcacaatccgtaagtttccgtgacacaccggaaatcaaaaggaagcatcgttgcataattaagtgaggttccgtaacattccgtaagtcaaaaaggggatgattatgtaatccgcaaggttccgtaacattacggaaagaaaacaagtatcgttacgaaattcgtaagtttccgtaactttacgaaaaaagaatcaccaaaaaaacagcagagggggtgtatttagtaaaaatgggggtgcaaatagcacccagacccacttgggccctccagaagattcctccagaaggcggttgcttctggaggaagcaaccctgctcgcctgggcgagctgggcggcaagcatctcccctattttgctataaataggggagaaaatgaagaagaaaaggatcccagccctttaggcacttctctctctttggaatttgcttggaaaaattgtttccgtgaagaaaatctaagccgaggcgcttccgaaacgtttccgtaacgttttccgtgaggaatctcgcaaaggtttgaaccgttcttcgacgttcttcattcgttcttcatcgttcttcgatcttcaacgggtaagtacctcgaaccaagcttttcgattcattctatgcacccgtagtggtccacattgtgtttcgtgcattttgattctcattttgtttactctttataccccctgttgacgtgcttaagccattttacttaagtcgtttctcgcttaacttaaaaataaaataaatttccaccgaacgtttgaattgtattatccattagcttcggttaaaataaattccgaccgttcggtcatgcccgtaccacgttggaaatcaaaaagaggtaaaaatatataataatcaaaagacatcttttagtaaaataagcgggaaatcaatcggacgttttctctttgggatttctcattcttaacccgattgattataactaaagtgaaacctagggctacatcactcgcctagtcaagctggtccacaaaaataagcttttgaagtttgtcattcacatttctccttaagtaaaatggatcattttaaaggtccaacgcgttaaaatgatcacccacttaagtaaaaaagaatcacttgataagaaagaactacgtaggtctgattttctcatcccaaattgaggaatacgtaggagcaaagggaaacacccttgtcgaccacaaaaaaggaaaaaatataaaaagggtataaaggatataagaacataaaagggaataaaaaaatcaaagtcatgtttgcacattcgattaaaggctgccgtcccttgggacgggcgtgtggggtgctaataccttccccgtgcgtaaatacaactcccgaacctttcaaacttaaaaattcgtagatcgcgtcttttccggtttttccgacgttttcctcaaataaacgttggtggcgactccgcacgtattcctttcgtggaacacgcatcccgcgagtcacgcgtcgccctcccgccgaagggtaggttgcgacagttggcgactccactggggacctgttttagagagttaggccatttaatcttgtgcaatgttttatcatgactttctcctttgttggtttccctttatttgtcttatgttcttgtgtatataaactatttgttgcttttagtgtattttaaaatgtatgcatgaggtaaatatttattcatttgatgcacacaaacaccaacactatttgcacacactgtgagtgaaaaaaaaagggccctatacccgggttcgtgggaacataaggagtggaggtgaatctgtgatcatgctaggtctccgacttgcttgattacagtgaaccctcatctagagcttttctctttgaaaacctattgttgctagtagtccctactgctacgatatgttcttcaaaggggatgatacctctagaaaccatcaagagagatataactaccttggggattattgctaaaagccctagttagttctctcccttataggtcctttaaataggggcacgaagcaaacacgctgcgtgccatttttcacactgccatgcatgagtatcatatacccttttgcttatgttcagtaaatattgtcatactgtgtacgttcccgcattgtgtcttttgcataagcattgcatacggattctttcttgatccctactgtaaacaaaccaacggagggtcccgtgtcgccttcttaaaaacgtgcgttggcggcattttgctacccctagacgtcgtatctaagaaggggacaaattccccggacccccgcattcctagattgcatctgtgtcatatgcactccatcatgcattcatccattccacccatgagatatcggagttttgatttgcaccagcttttatctcactttagtaagcatgggaacaaatcaaaccggcaagaggttttaccaagtcaaggtcaaaagcccagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcccttgagatgcttcacattcggggacttccaattagtaccaaccattgaagaatttgaggaaattctaggatgtcctctcgggggaaggaaaccatatcttccctccgggtgtctcccctctttgagcagaattgcaactgtggtcaaggattcagccagaggtttggaccgcataaaacagactcggaacggcatagcgggcctgccacagaagtacctagaagacaaggcgaggggtatggccaatcaaggagactgggtcccgtttatggatgtgttagctttgctaatttttggggtcaccctctttccaaacgtggatggtttgatagacctagcagcaatcgacgctttccttgcctaccaccatagcaaggaaagtccggtggtagccgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcatgtactgaaaagaggagaatagattgggaccagctcttggccgggataggaggtagaacaatcagttggttcccccgatggaaggaaggaaaagaaggagtcctttcctcgtgtggaagatacccaaacattccgctggtagggacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaagcatgggaaaccccgttaaggaaagatcaagagcttagaggcattcgtaatggcatcattggtgggtaccaccaatggctgaaagttcgcatacgaggtttagattggctcgccaagttaaaagtcgtcagcgaagagaattttgaagcaccggaagcggatgaagaagtccaagctctcaaaagcgagttaggaaaggcaaaactcgccaaggagaagttcaagttggctgctacacacgttcggaaggagtgtgccgggttacgggaagagaatgcaattaccgcaagggcccttgaacaagagaccaagagggctcgcagggaagagtatggccggaacaaatttcgcggagctctatggggtagcaataatgaactcaagttgcgaagggaagaaagggaccagtcgcgagcacatagcatggttctgaaagaggagttgattacttgttcaaggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcagtttgctcttaccttgaacgggagtcaagaacttccccgattgttagccaaggccaaggcgatggcagacacctactccgcccccgaagagattcatgggcttctcggctattgtcagcatatgatagacttaatggcccacataattaggaatcgttaaagaaacttgtatggtctctcagaccttgactagatatgatttctttttttataaaatgagttggtcccatgtttctactccaaaaagcttgtgcaaatcaaatcactcctacatctcatctctagcatgcattttctttctttacccactcctcacgtttggttttttagggaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactcccttggcaactacgcaccatcctccctcaaacatagtaggacggggaagggacacactgggacacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattacgctcgaagggatgtcgagttctatcccccgatccccggaagggccggcaccaggcacattgcctcaacccaacatcgcagcaccgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaagttcaaagtgccggacttcgacaagtataaagggacgacttgtcccaaaaaccacctcaagatgtactgccgtaagatgggcgcccattctaaagatgaaaagctgttgatacacttctttcaggatagcttggccggagctgcggtagtgtggtacactaatttggaagcttcccgtatccgtacttggaaggatctgattaccgccttcctaaggcagtatcagtacaattctgatatggctccagaccgtactcaactgcagaatatgttcaagaaagagggtgaaacctttaaagaatatgcgcagcgatggagggatttggcggcacaagtagctcctcccatggttgagagagagatgattaccatgatggtagacactctgccagtgttctactatgagaagctagtgggttacatgccgtccagctttgcggatctggtgtttgccggggaaagaatcgaggtgggattgaagagaggaaagtttgattacgtttcctccacaaacgtgaacgccaaaagaatcggggcaacaggggcaaaaaggaaggaaggagatgcccatgccgtctcttcaacgcccgcatgggtcaaacccccagcaaacacctcatggtacccatcagtacgcgcaacatcacccaagcttctcggctcctgctgggaacgcctctagctcaacacccgtacagcctaaggcacccacccagagggaagctccccaagttccaactccgaacgcgactcgaccagccggtaattccaacacgacaaggaacggccctccgaggccgttgccggaattcaccccgctcccaatgacgtacgaagatcttctaccatccctcatcgccaatcatttggccgtggtaactcccggaagggtcttcgaaccccctttcccgaggtggtatgaccctaatgcaacttgcaagtaccatgggggcgccccggggcattccatcgaaaaatgcttggcccttaaatacaaggtccaacatctaatggatgccggatggctgactttccaagaggatcggcccaatgtgaggaccaacccgctcgccaatcatggagggggggcagttaatgcagttgaatccgataggccccacaggtctaaaccgttgagagatgtggcaacccctaggaggtttatctttgaggccctacagaagggaggtgtaattccccatagtgggtgtaaggaggattcctgtctgctacatcccggcgagatgcatgacatggagacgtgtttggaagtagaggaattgttacaatggatgatagaccaaggtcgactagaagtcggcattaaaggaaaagaagagccgcatatatgcatgcaatctacggaggggagcggtattgcgaagcccaaacccttggtgatatactttactaaaagtgcagcctcgcaaaagcctgggcatcccttaatggtcaaacctgttcctttcccgtaccagaatagtcacgcggtcccgtggagatatacacctccggagaagaaggaagaagaggtcacagacatcagctcgctgtcggctaaagtaacaaatatcacgggactgagtggtgtgacccgtagtggtcgtgtgttcgcacctccggacctaccggtccaacccgccgacgtcaagggaaaaggaaaggtggtggaggaacaagatggcgaagcaccccacgcttcgaataaagatattccagcaaaggggcccccagagaaaagggatggtagaaaggaggtgtcgctagaggaagccagcgagttccttcggataattcagcagagcgaattcaaggttatcgaacagctcaacaaaaccccggctagggtctcgctgctagagttacttatgagctccgagcctcatcgggctctgctagtaaaagtgctgaacgaggctcacgtggcccaagatatttcggtagaaggtttcggagggctggtcaacaatatcactgccaacaactatcttgccttcgccgaagaagaaatccccgccgaggggagagggcataataaggctttacacgtatcagtcaagtgtatggaccatatcgtggccaaggtacttatcgataatggttccagtttaaacgtgatgcctaagagcactttggacaagttaccattcaatgcttcccatttaaaaccaagttcaatggtggttcgggccttcgacggcactcgccgagaggttaggggagagatcgatctcccagtacaaataggccctcacacctgtcaagtcaccttccaaataatggacattaacccaccctacagttgcctgttgggggcgcccgtggatccattcagtgggtgttgtgccttctacactccaccaaaagctgaaattcgtagtggaggggcacttggtcatcgtgtcaggcgaggaagatatcttggtaagctgcccatcctccatgccttatgtggaagccgcagaagaatcgttagaaaccgctttccagtcttttgaggtggtcagcatttcctccgtggactccctctttgggcaaccttgtctgtccgatgcggcggtaatgatggcccgagttatgttggggaacggttatgaacccgggatgggtttaggcaaagacaatggcggcataactagcctgataaaaacccaaggaaatcgtgggaagtatggtttaggctataagcccactcaggcagacgtgaaaagaagcatcgcgggaaggaagaacagtggtcagagctcgcgttggagacaagaaagtgaaggaagcccgccctgccacataagtagaagttttataaatgcgggtctgggagacgaaggtcaagtggtcgcgatatgtgaagatgatgttccaagaactctggatttggtccgaccatgccctcctgatttccagctgggaaattggcgggtggaggaacgccccggcatttacacaacaagcataatgtaaacctttacgtttttaaaagctctatagttgggcctaggctttagagttttcattttgttaaggctttgtgtcttttgtctttgaatttataatacaaagatctttcttcatctgttcctggtctctacccattctcattcatttgcatgtttacttctttttctgaaacggcagatccgatgacgagtcccccgaaggtactaatacctgggacccgtctatcaatttcgagcaagaaatgaaccaaacggaagatgaaggagatgagggggtgggacttccttcggaactagaaaggatggttgcccatgaggaccaagaaatggggcctcatcaagaagaaacagagctagtagacttgggaattggcagtggaaagagggaagtaaagataggtgcaggcattaccgcacctatccgtgaagaattaataaccctgctaaaagactaccaagacatctttgcttggtcataccaagatatgcccggtttgagttctgacattgtgcagcaccgattgcctctgaatcccgggtgttccccagtaaaacagaaattgaggaggatgaaacccaaaacgtccttgaagataaaagaagaagtgaagaagcagtttgacgctggatttctggccgtcgctcggtatccagaatgggttgccaacatcgtaccagttcctaaaaagggtgggaaagtacgaatgtgtgtagattaccgggacctgaatcgggccagtcccaaggacaattttccgctaccacacatcgatatcctcgtagataacacggccaattttgctttattttccttcatggatggtttctctggttacaatcagataaagatggcacccgaggatatggaaaagactactttcgtcaccctgtggggaacgttctgttacaaggtgatgtcctttggactcaagaatgccggggcaacttatcagcgggccatggtagctttgttccatgatatgatgcatcaagagatcgaggtctacgtggacgacataattgctaaatctaaatctgaggaagaacaccttgtcaacctgcggaagttgtttgaaaggcttaagaaatatcaattaaggttgaaccccgctaagtgcacctttggggtcaaatcagggaaattgcttggtttcgttgtaagccagaaagggatagaggtagaccccgaaaaagtgaaggctatccttgagatgccggaaccccgtacagagaggcaagtccgaggtttcctggggcgcttgaattatattgccagattcatatcgcagctcacagccatttgtgagccgttgtttaaactcttgcgcaaaaaccaaactgatcggtggaatgaggattgccaagaggcttttggaaagatcaaaaagtgcctaatgaatcctcctgtgcttatgccaccagtacctggaaggcctctcattttgtacatgacaatcttggacgagtcaatggggtgtatgctggggcagcatgacgaatccgggaagaaagagcgcgctgtttactacctaagtaagaagttcacgacctgtgagatgaattactccttgctcgaaagaacgtgttgtgctttagtatgggcgtcccatcgcctaaggcagtacatgctgagccatactacctggttgatatccaaaatggacccggttaagtacatctttgaaaagccagctctcacaggacgaatcgcccagtggcaagtcctgctatctgagtttgatatagtctacgtcacccaaaaggcgataaaaggaagcgctttggcagattatttggctcaacagcctcttaacgactaccagcccatgcatccggaattcccggatgaggacatcatggccttgttcgaggaaaagttggacgaagatcgggacaaatggactgtatggtttgacggagcgtcaaacattctaggtcatggcgttggggcagtgttgatctctccggacaatcaatgtgtacctttcacagccaggctaggattcgactgcaccaacaacatggccgaatatgaagcatgtgccctagccgtccaggcagcaattgactccaatgccaaactactcaaggtgtacggcgactcagcgttggtaatccatcagctgagaggggaatgggaaactagagatcccaagctgataccctacaaagcctacatcaaggaattggctaagactttcgatgagatctccttccatcatgttccccgcgaggaaaatcaaatggcggatgcacttgctacattggcatctatgttccagctaacaccgcacggggaccctaccctacattgaatttcagtgtcgtggcaaacccgcacattgttgccaagtggaagaggaacgggacggaaagccctggtattacgacatcaagcgatatgtcgaaagcaaagaatacccgccggagattgccgacaacgataaaaggacattgaggaggttggcagtcagtttcttcatgagcggaggcacactgtataagagaaatcacgacatgacactcctgcgatgtgtggatgccaaggaggcaaatcacatgatcgaggaagtccatgagggctcgtttggaacacacgccaacgggcatgctatgggccaggaagatcttaagagcaggttattactggcttaccatggaaagtgattgttgtgtccatgtgaggaagtgccacaaatgtcaagcgttcgcagataatgtcaatgccccaccacatcctctgaatgtcatgtccgccccttgggcctttctccatgtggggaatagatgtcatcggggccattgagcccaaggcctcgaatggtcatcgcttcatcctcgtagcgatagattatttcaccaagtgggtcgaggcggcttcatataccaatgtcacgaggaatgtggtggtcaggttcattaagaaagagatcatctgccgatatggtttgccaaggaagattatcacggacaatggcaccaacctgaataataagatgatggcagaaatgtgcgaggagtttaaaatccagcatcacaattccacgccctaccggccaaagatgaatggagccgtggaagcagccaataagaatatcaaaaagattatccaaaagatgaccgtgtcatacaaggattggcacgagatgctcccattcgcgttacacggttaccggacttcagtgcgaacgtcaactggggcaacgccattctcattggtatatgggatggaggcggtgttaccgtttgaggtagaagtcccgtcattaaggattttggcagaatccgggttaaaggaatcagagtgggctcaaacacgctacgatcagctcaacctcattgagggtaagcgcttaacggccatgagtcatgggcgcttataccagcaaagaatgaagagtgcattcgacaagaaagtacgcttacgcaagttccatgagggagaccttgtgctaaagaaaatgtcccatgctgtcaaggaccatcgagggaaatgggccccgaactacgaagggccttttgtcgtgaagagggctttttccggaggagctctggtgcttaccaacatggatggcgaagagctaccttcacccgtgaactctgatgtcgtcaaacaatattatgcttagaagctggggcaattaaggatgtcgctgcatgttctgtatctttatgcgttttctggatttcccccagggatttcctgtctgttgtatctctcgttacaatctttcaaagaaatgaacgtggattcgaggcttttagtcctcacgttagtttcacatcttgcgttaatttgtgatcacctgagcccttccgctcagttcatgggatcccccaagcgcttaattagaattgaacctgaaccaactttccctaaattttctgcgtttgaaaacattcatgcatacgcatacgcatacgcatgtatattgttgtggtaaaacaggggcaggatcaccttgggctactttctggagtgaggacaaaacaggaatggcagaaaccagtcaaggtagggtaatgatgcggccaaaattggccatacctggttgtttattacttgcaggtacttaaggatgaacgcaagcggggatggggtcacgaccgaccgatcgttgcccttctctgtgcgaaacaagcagggaatgtcgctgcaaggcagccccgtatcctttctattttgtagctttcttttactatttgtttgttttaaaaaaaggaaaagagtaataataagataagtaatcaacgcctgattctaacctaagtaagttcaagttaggcaaaaggctaatccatgagaagggaggggacatggtcaatgttcccctcaaaaaaaaaaaaaaaaaaaaaaaaagtgcaggttagctcgcctgggcgaagctgggcttcgcctggggcgagcccacctctgcaccaaaatataaaaatgacgaagggggggatgttttttttcattcaaaaacttccccccctcattcaaaaaaagaaagctcacgggactcacggattttgcagcccttaggtcaccattttttgcgtttttgattccgttttgctctattattcgtctccaacaagtaagtacctcattcttgggctttctagctttccattgatgtattttggtgctctaaattgcatgtgtttgctaagaaacgtgagggatttatcctcaaattgttgcttgtttttgttgaattgaggggttgtaagggatggccttggcctagggtgtattctgaagtaatggcgcatgccacattgtccccattctcttgatattcgtgcctaaacatgcgcccaccaagtgctcggtgaaatgcctcaacgacatatgagcatggttttgtgagctttgggttgtgggactgttttatatgtatagggacagcatgaaggatttaaaatgaatgcccgaatgcaattctaggcctaggaacccaagcttttaatttcaatacaaggaagcatgacttacgcctaggaatctaagttttggttttgaatgtaaaaaggcatgaatattaggacatgtttgagaggttgttattagaatttaaatttggctgccccatgaggaataccttgcacctaggtagcatggaaaatacctttcaacggtatgtatatatgtgaatatatatagcatggaaatgccttgcaaaatatgaatatatatagtatgaaaatgccttgcataatatgaatatatatagtatgaaaatgccttgcataatatgaatatatatagcatgaagtgccttgcaaagtgttggatgggtagcgtaaaagtgtttttcaaaatatatgtatttgtgagtaggtaataaaagaaaccttccaaaaaatgtatatatatataggatgtagcatgaaaaggtttgtcaaaaaatatgtacatggataggtgtcgcaaaatgcttcacacaaaattttttatgtgtgcaaatacgtatgtgtcataaaatagcacgaccccaatatgattattttataaagtgcatgttgacactcgggccatgagaagtgttgtttggcccttgtttgtaatgattgttatatttcttgtaaactaactttccaaatgtttgccttcgcaggaatggccccgaggaagcttgcctcaaagaggtccaggaaggacaaggcggccgaaggaactagttccgccccggagtacgacagtcaccgctttaggagcgttgtacaccagcagcgctttgaagccatcaagggatggtcgtttctccgggagcgacgcgtccagctcagggacgacgagtatactgattttcaggaggaaatagggcgccggcggtgggcaccactggttactcctatggccaagtttgatccagaaatagtccttgaattttatgccaatgcttggccaacagaggagggcgtgcgtgacatgaggtcctgggttaggggtcaatggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaggattttgcccggaccgctgcagggaggcgagtgcgagtcatgcgcaccaacatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcaggtatggcgcccactaggcaccctttggacccagataagtccaacagggctctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgtgccaccaccacctcatcaggctggccaggctggggcatttgacatagagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaagttgcatggcccggagattggcccgaggcccaagcaggagaggcacccccagaagctcccggcgatggagaagaagcccacgaggatgaggaaatggctgatttgcttgacttcttgggagggagtggagacacgtgactgggagatccccagattcatgttttctttcatatttcttttgtcatttttttgttctatgttattgttttgacttgagagactaacgtttgtttttgttgtttcgattgtcattttgtacagtgcatacatttttgtttagattggtgcgttagtatttatatatcattactatcgatgatgtttgaaattctggaaccgtgtagagttcttcgtttaggaacatcgtccaaagtatatatgtaaaataaacaaaaaaatcatgataaaagtaaaaaatagagaaggaaagaaaatgaaatagaaaaggaaagaaaatgaaatagaaaagaaaagaaagtgataaggaaaaagagaaggcaagagaaaataagttgtctagctaaaaaaccaacatgcttttgaaaagagacgatttccaacttttctttgaaaaaagttcattgatcataaccaattcttggaaaatgtgtctacacctgaagggtgaatgctgtgaaatttccccggatgcccgaaatggactcggatgaatgcacaaattgataaaagaacatattttggaaacattgggtcgattaaaatagagggaatgaatcctgagccctagcatcacatgaccataaaagtttgacacttgagtgtccgcgtagatgcatgcatgaccagttttgcataaagtttccaaatcatcattttcgcatttgtgtcatggaaataatgtggggcatcccttttatccttgaaccaaaccaaaccctgacatgtatcatgtctagccattctacaaaccttgattcaaaatcatgactcactataatccttaccctcggaagcaaaaaaaggaaagaaggaaattttccaatcaaagagaaagcaaaaagaaaagaaaggaaattcccaatcaaagagcgggagaaagcaaaaagaaaagaaaggaaattcccaatcaaagagtgggggaaagcaaaaagaaaagaaagaaaattcccaaccaaagaatgggagaaagtaaaaaggaaggaaagaaagttcttgatcaaagaaactagaagaaatgtgcagaaaggtcttttgaccagacaatatctgaacaatacagaattgtcaccaaatgaacaaaaaagaaggaaaggaaaccacgacctaaaatggtcttctccctttgtttaccaaccaaaatcccgtgcgctagcgaccttttttctcgccccgcactaaacaaaaaaaaacagacagaaaaaggaaaagctagaaaaatcaaaagccaaaaacacacaaaagccgaaagaagaaaccaccaaaagaacccattcccaagggaagccctattgatccatgatcacgcgtgtaatttttgatttgataggaaataatttgtaaagtcaagtcatgacatatctatggttcggaattaggatgaaacacttacctgtgcgagattgatacactttgagtagatttcttctatttttgtcgaacccagtgtttcctctaaatggtcatttagaaacgaaatgctaacatccaagatctcatttatggttatggggggatcccatcagcagactctccttccctggtaggcgcattgtttgtcactcaaaaaaaaagcatatgctgctctaaatcagttggaatatttgtctctttgctaaagcatgtttgcattttagtggagaaaacaacgaaactttttcaagcctcacaagttatccagaactacgtaggtctgagttcctcattggaggatacgtaggagcaagagcctcgcttttgtcgaccacaccgccttttgttgccataactcaagagctggtagtacgcggagataccttacgcttatccgcaccccttttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcaccccttttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgtccgttggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatcccccccccctttgccattcagacacagtcgtgttcgatggcaagcagagaccaagtttggtcattctgcacccatgatacgcggagataccttatggttattcgcacccattcttttgctatctgtaagacagaacgcttgatagcatgcaggggctgacacagtcttctgcaccttttgttcctctgggaacaacaagtcatttgcatgtggagattttatggtcacccgcgactctcgtcgaaacgagaaggacgaaattagtgtcttatctttacttttcttttatctccaataaaagacaagtaaagaggggcaactgtcataccctaatttcgtccgggaacctttgctcgatgacatgcgaccattctttggtccttgtgaggtgcttggcacccatcattaggcaatttatgaaattccaggacatgccgaaaaaccaaaaaaaatattgatgcacaatccgtaagtttccgtgacacaccggaaatcaaaaggaagcatcgttgcataattaagtgaggttccgtaacattccgtaagtcaaaaaggggatgattatgtaattcgcaaggttccgtaacattacggaaagaaaataagtatcgttacgaaattcgtaagtttccgtaactttacgaaaaaagaatcaccaaaaaaacagcagagggggtgtatttagtaaaaatgggggtgcaaatagcacccaggcccacttgggccctccagaagattcctccagaaggcggttgcttctggaggaagcaaccctgctcgcctgggcgagctgagctcgcctgggcgagctgggcggcaagcatctccccctattttgctataaataggggagaaaatgaagaagaaaaggatcccagccctttaggcacttctctctctttggaatttgcttggaaaaattgtttccgtgaagaaaatctaagccgaggcgcttccgaaacgtttccgtaacgttttccgtgaggaatctcgcaaaggtttgaaccgttcttcgacgttcttcattcgttcttcatcgttctttgatcttcaacgggtaagtacctcgaaccaagcttttcgattcattctatgcacccgtagtggtccacattgtgtttcgtgcattttgattctcattttgtttactctttataccccctgttgacgtgcttaagccattttacttaagtcgtttctcgcttaacttaaaaataaaataaatttccaccgaacgtttgaattgtattatccattagcttcggttaaaataaattccgaccgttcggtcatgccgtaaccacgttggaaatcaaaaagaggtaaaaaataatataataatcaaaaagacatcttttagtaaaataaagcggaaaatcaatcggacgttttctctttgggatttctcattcttaaccgaattgattaataactaaagtgaaactaaggctaacatcaactcgcctagtcaagctcgtccacaaaaataagcttttgaagtttgtcatttcaatttctcactaagtaaaatggatcatttttaaggtccaacgccttaaaatgatcaccacttaagtaaaaaagaatcacttgataagaaagaactacgtaggtctgattttctcatcccaaattgaggaatacgtaggagcaaagggaaacacccttgtcgaccacaaaaaaggaaaaaatataaaaagggtataaaggatataagaacataaaagggaataaaaaaatcaaagtcatgtttgcacattcgattaaaggctgccgtcccttgggacgggcgtgtggggtgctaataccttccccgtgcgtaaatacaactcccgaacctttcaaacttaaaaattcgtagatcgcgtcttttccggtttttccgacgttttcctcaaataaacgttggtggcgactccgcacgtattcctttcgtggaacacgcatcccgcgagtcacgcgtcgccctcccgccgaaggggtaggttgcgacatcaaggaaatggatgtgcttatgattcaagcaaagattgaagaagatgaggaggtaactatggctcgatttcttaatggtttgactaatgatattcgtgatattgttaagctgtaggagtttgttgaaatggatgatttgcttcacaaagcaatccaagtagagcaacaattaaaaaggaaaggagtggctaagaggagttttaccaactttggttcttctagttggaaagacaaaggtaagaaagatggggctgctacttctagtagttccacacctaccccatcaaaaactcgctcaaagtcccaagaggaaccctctaaaagaagtagagatgtgaagtgtttcaagtgccaaggcctaggacactatgcttatgagtgccctagcaaaaggtccatggttcttagagatggagaatatataagtgaatccgatgttgaagaggaagaagagagtgagtacgtagaggaagaggagactccggagggagatttgttgatgattagacggttacttggtggtcaattgaagcataaggaggagagccaaagagaaaacatatttcaaactagatgtttaatcaatggcaaggtgtgcatggtgatcattgatggaggtagttgcaccaatgtggctagtactagattagtgtcaaagctaaatttagctactaaaccacatcctaggccatacaaacttcaatggcttagtaaggatggggaggtacaagtaaggcagcaagttgaagtggatgtttccattgagaaatacaatgataaggtactttatgatgttgttcctatggaggccagtcacttacttttggggagaccatgacaatttgataaaagagccaatcatgacggttacatcaaaaagatctctttcatgcaccaagacaaaaatattgtgctcaaaccattgagtccacaagaagtgtgtgaggatcaaaagaaaatgagagaaaaacttcttcaagagaaaagagaaaaagaaaaagtgagcaaaacacttgagagtgagaaaaagagggaaacacttgagaggaaaaagagtgaacaaaagaagagtgaaacacttgaagtgagggagagctatttagccacaaaaagtgaggtcaagaggttgtttcgtgctaaatagtcactatacatcttgttttgcaaaaatcagattttaaccaataacacttttgatgattttgaagtgccttctagtgttaaaactcttttgcaggattttcaagacatgtttccatcaaatgtgacaagtggactaccacctttgaggggaattgagcatcaaattgatctcattccaggagcttctttgtccaataggccagcctatagaagtaatccacaagaaaccaaagagattcaaagacaagtggatgaactcattagcaaaggtagggtaagagatagtatgagtctttgtgttgtcccggtgattttggtccctaaaaaggatgagacatggcgcatgtgtttcgattgtagagcccttaataacatcaccattaaatataggcatcctatacctaggcttgatgatttgcttgatgaattgcatggtgcatgttacttttctaaaatcgatttaaaaagtggatacaatcaaattaggattaaagaaggggatgaatggaaaactgcttttaaaacaaaatatggtttgtatgaatggttggttatgccctttaggcctaactaacgctcctagcacttttatgagattaatgaaccatatcttgagagagttcataggaaagttcgttgtggtgtactttgatgatattcttatctatagcacttcacttgatttgcatattattcatttaaaatttgtcttgtgtgtgcttagagaagaacaattgtatgccaatcttgaaaaatgcatcttttgtactaaccatgttgtgttttttggattggttgtaagttcaaaaggagtgcaagttgatgaggagaaggttacggctattcaagaatggcctacacctaagtccgtgaccgaggtgaggagttttcatggcttaataagtttttatagacgatttgtgaaggattttagcatattggcagcatctctcaatgaagtgctcaagaaaaatgttggtttcaaatggggagagaaacaagaagaagctttcaatgttcttaagtaaaagctaactaatgcccccatacttgcattgccaaactttcaaaaatcttttgaaattgagtgtgatgcttcaaatgttgggattggggctgtgttgttgtaagaaggccatcgaattgcttattttagtgaaaagttaagtggtcctatccttaactattcaacttatgataaggagttgtatgccttagtacgggctttgaaaacatggcaacactacctttatcccaaggaatttgtcattcatagtgaccatgagtccctcaaatatatcaaggggcaaggcaagcttaacaaaaggcatgtgaagtgggtggaattcctagagcaattcccttatgttatcaaacataaaaagggaaaaggtaatattgtagccgatgctctttctcggcgtcatgcattactttctatgcttgaaacataattgattggtcttgaatgtttgaaaagcatgtatgaaaatgatgaaacttttggagaaatttttaaaaattgtgaaatttttcagaaaatggttactttagacatgaaggctttcttttcaaagaaaacaaattgtgtgtgcctaaatgttctacaagaaatttgcttgtttgtgaagcacatgaatgaggtttaatggggcattttggggtccaaaagactctagaaacattacaagaacatttttataggcctcatatgaaaaaggatgtgcataaattttgtgaacattgcattgtatgtaaaaaggcaaagtctaaggtaaagcctcatggattgtatactccattgccaattccggagtatccttggattgatttatccatggattttgttttggggctgccaaaaacaagcagtggtagagattccatttttgtggttgttgataggttttctaaaatgggtcattttattccatgtaaaaaagttgatgatgcttcccatgtggctgatttgtttttcaaggagattttgagactccatggtttgccaaggagcattgttagtgatagggactctaagttcctaagccatttttggaggactttgtggggcaagttggacactaaattgttattttcaaccacttgtcacccacaaaccgatgggcaaacggaagttgttaataggacattgggaactttgcttaggacagttttgaggaagaacttaaaaacttaggaagcttgtttaccccatgttgagttcgcttacaatggagttgttcatagcaccactaattgttctctttttgaagttgtttatggttttaacccactaactcctcttgatcttttgcctatgcataatgtttctgtttttaagcataaagaaggtcaagccaaaggcggactatgtgaagaagcttcatgagagagtcaaaaatcaaattgagaggagaaataaaagctatgctaaacaagcaaacaaagggagaaagaaggttgtcttcgaacccagagattgggtttgggtgcacatgagaaaagaaaggttttcggaacaaaggaaatcaaagcttcaaccaaggggagatggaccatttcaagtgcttgcaaggattaaagaatcaatgacaatgcttacaaagttgagctgcccggtgagtataattttagtttccaccttcaatgtctctgacttatctctttttgatgcagatggagaatccgatttgaggacaaatccttctaaagagggagagaatgatgagggcatgaccaagagcgagggcaaggatccacttgaaggacttggatgacctatgacaagggctagagcaaggaaagccaaggaagctcttcaacaagtgttgtccatactatttgaatacaagcccaagtttcaaggagaaaagtccaaggttgtgagttgtatcatagcccaaatggaggaggactaaatggcaccactttgtctcaattttagagtgtttagtttgtctaaataatggctcaatccttgtaaagttggctgaccataaatatgttttgggttaatcaactaaaaggactttagtttggtttagttcaagttgtaataagggcccaattggcaacctaggcatcagccttttaggagaccaaatggtggctggcttgatggctgttaggggtgacttttggttgccacaattttagttacatttagccattaagttcttttaattccataggttagtggcattaagttcttcaattataggttagtggatcattactaaaatctgatgtaaagcttctatataagctgaaccattttatcaataaacacaagtttagttttattcagaaaattaaagtttatctcttttatcttagtgagagtgattctcctaagttcttgagtgattcaagaacaccctggctatatcaaaggactttcacaatctttgtgtgttgccctcgccggaaagagtgattctttccttcctttcatcttcaaccttgttctttcaaaccacaattccagaaaatccacttctgcccataattatctcgtggccataactcctgttttacgcgctcaaattaagtgattcttgagcctaaattgaatttcaaaacgagatctttcacctcgttttggaatcacctcatttggagccctgtatcttgagttattgccatttctatatttctgtccaaccaccacttaacctacgttttatcatctcattcttccattttatgccaagaatcaccttattaaggccaatgaaattagccactgctcaacccttaaatcttgccaattttccatcctttccttaatcaatttccgcattttccatcaaggtttaatcctagacgatcctaagtcttcctctgtgcaatgaaggttcatatcaatgaaatagcctctcaatgcataaaacaaaaaggtaaggagagatgggatctccctgtctaacccctttttctagtctaaactcctctagaggttcactattccaaaacatacgtatcttggatgaagagatgaaatgccaaataatgttcacaaagttctttgggtacccaatatcctgtaaagcatctcgaataaatgcccaattcaagcaatcataagctttctccagatcaatttttattgacatccatccatttgtagttttttgtgtctcattgaatgaaaaacctcttgggaaataattacattatctctactctgatggatgggaataaagttgacttgacaagggccaagtaatttctccatcaagggccttatacaatgagaaagaactttagtgatagctttgtggaaaacattacataagctaatcagtctgaaatccttcaatctagtcatatgtttcaccttggggataagagtgatatgtgtatcattaatctgatgcaccaattacagatcctgaaacacgctttgaaccaacttgacaagagcatcccccgctgtattccattgactttaataaaaaaaactgcatggaagccatcagggctaggagccttaaatgctcccatattcctaataatgttaagaactttttgtgaagacacatcaactccaagggaaaaaacaaattcctcatcaattagaggaaacatacttgttacagggaactcatcaacacactgatcatcaacaaataggttctggtaatattgagtcaccatacttttcaaagattccccatccgaaacccaggtaccatcttctccctgaagagtctcaactctactccttctcctcataataatagtagttccatggaagtaacttgagttatgatcccccaatgagagccatttggaataagctttctagaaccacaaaatctcttcctgtagcatcacaacctcatattccctccacacagaatacaacatatatgcctgggtggacttatccctctcacccatccacttgttaattctatccatccgcctgagaaggcttcatttcttagagaaaaaaaattcctaaacacatttttattccaatcttgcacatctttttgaaacaaacataacatatcaaaccaagacaaaaaagagttccaatgggaatgcacaaacctcttgaaatcatcatgagtaatccatgcagcctaaaaggtcttgtttgagagtgatgattcctttccacctctaatctaaccaaaaggggtctatgatccaatttaaaagggggaagatgcagcatcacagcctcttggaattttattctccactgcaagttaatcaagagcctatccaacctctgttcaaggttgcctcttttccaagtatatggttacctttgaaacccatcatatattaattcacagtttgaaatcatctattgaaagcttgtaagatcacaaagagatggattgtcagcacctccaaccctttcatgtggatgaagaatggaattgaaatcaccaatgataggctatgacttatcaatctcacaagctaactctctcaacacatcccacataccctgcctgcactagtaatgagaactattataaaccaccattaataaccaatcattagaactcttccaactaaccttcagatgcacatggtatctagaatttcccagcatctgaaccttccataagcttgaatcccacaagcagcaaataccactagagtggcccacaacttcttccacaacccaatccttggataattttcgtggcccttgcaccactagagtgggtctccataaaaaatattaaagaggatggatattcccttttgatatctttaattaaagaagcaaaaactctattggacatactgtgacaattgcaagacaaaaaattcatggaggcatagcaacatggatggccttaacatggccttggctaccctcttggcaaactaccatatcatcattctcatttttgaaactagcattactacgaccacctttaatttgtgcctcaccaacaatgcttgggtcagttggcacaacttccttttgcctctaacgctaaagactgctttctatagagccttaatcattttaagctcttagtccctatcaataatccttccctgtggtggttaagaaggttcttgactcactaagcttaaaacctgttttcccttcttagaggccttccctttattggcaattcccattttagtatttccctttatttgcttttctttcggcttccttaaaactgggcctgtgtttttagttggcccagttttaccctcttctaccacatagttcgtcttcatctccttaaaaacaactcccctattctgtttctgaacaccctttgggccactagtgctaggcccattagcattacgcttaactctagagaccaacctttcctcacgtgcttcattaagagcaatgaattttgacccaaatgatttgttgttgcgatcctcacatccctgtgctacaatcttggtatgattggcaaggccaaccccattaaagagaacttttaactaattcttcctcacactcctacgcactaattaccaaggcccgaaatgattggcattatcattactcaaaacattcacttgattttcgttttcaaatctggaccattaatattattcattacgccattatcatgcacacgccaccctgtcaactatctccaccttagccaccatatatctccaccagttttttcgtccctcggcttttgttgggattggatatccacaacatcggctttcatctccacagagtttgcatccttgtacccatacctcccacaattaaaatagatcaaatgcaatccttcatattgtagatttaataagtaacctctagcaataatcttaggctgcaaaggtttgaatagatcaatctcaacacagattcttgtgaaacaaccccttgcttggatagtcatcactctgtcgattttaagcattactccaggagtagaccctaatctccataagaattggtcgttgaacaattcaataggaaattttgggaaccttatccacaaccatcctcctttcgacatgcagattacccaagaggaaaggacgccatctttacaccagaatataatgatcaaccaccatccatgccgccccccccccccccccatgaaagcatggttgtaatcctcacctcatcagatgtgaacaaaatctaatagtagtttcttggcacatcaatgatcaatgatcttgatagcaccattctttgcccactcacaattaaacttggcctcctattgctgaaaacccaatctcttccccatcaccatgaccatcaaggacccccttccatggcttacaccagtcactaaactccttatcggaaataggaacttctgggaaacgttcaaagtcctccttagatattggcgtaggaggtattttctgatctagatacccaaaacatctcccatcaaaagttgaaaaagccattggaccaccattcttcaaaagcttctctctatacgtaccatctggcacaccttgctcggcctccttatctttatcaagctccatctccgaattaccatcaccttcctcattaggcttcctattgactttcctagtactacgctggatatcatcttcctccttagaggattcagaagaaaccctagtagaactctcaacaccctcgattacaaattatttatccctagtgggttcctgatggacattaacatagctattcatttataagttacacttacatatatttgcaaggcatccatgaatatctatggatatttcctaaaacttaaaatataaaaataaaaataagcaactaaattattttatgagctctgcacaaataggcgctgcaaatatcactataaaatgataaattaaagagttggggaaaataatcactttcacaatttttttaattattcttctattttttttcctaaaaaatagtttaaaaacccacaaatttacattccttttctcccatataagataaatgtataagatttgtcatatttctggaaaaaaatgaaattattcaaattatctaaaaatttctctctttaaagtataaattcaaataaaactacacgtcgaaacatcaattatttataagtatatccatattaattatttataagtaaatgcactttagtggtagctggtatctatgagtatatggatagtataaaatccgttcccgttccatttacaaataggttaagaaaaaaacctatttcaattaattataaatactcatttaaatattcatttttccgtgacaaattttacctgtgagtattcacgggtacaagttttgaagtccttgcattggtttgcatcttttacacgtttttttctttcacaaaaaaggtatttttttaatacacatcttttacaagtatttaaggattcgtatcagtttttgtcatagtagtaactatttagtatcttttttcatttaagctgtcctctgcttattcatgataatgacggctaactgttaagtttcttcttgtatctgtttttattttattttttctgactttgcccaacggtttatgattgccgagctgctattggttccactaagcttgaccctgtaggaaatattttcctttttgctaatttggaattatgactattggtccaaacatggagataagatcattgcatttatccattttattgagattaattaagtctaaacataagttgaaatctgcccatgcaaccaacgtcctttcatttttaaataatgacataatatgtgtcaccgtcgttgctctcaaattcaattaactcaattgagtgaataaccaaacaactcgactggtaacagtaacatcagctatgtttcaatttcaaagccttctattctttcgaaatcgtatatatattatgttcgcctattttatcacgacaaccttatgcagagggtttattttgtgatgtacggaaaaaaaaattatttattccatgactttaaaataattattattttagattattttatataaataaaaattaataaatagatgaaataaaataataatttcataaaattcggtatcttaatattaataattactttaaaaaattaaatatgatatttattttgagataaatttattttcaaatataatacttattttaagaaaaaaatacctattaattatttcccacacagaaagaagcagacaaaagtgttcaaacgatgcatacatgtggctggaaataaaatataaatagggttatttaaacaactctttttctatgcttttgattattgattagtttcgcaccatttctggcttcagatgatacttggggtgtagatataaggggaaaataaattgggttgattaggtctaaatatgtattatcaggtttcaaattatagttggtttcgttcggtttttttgggtacatggcttgtttcagtttaaatctgaatatattaaaaagattaaaataaattaattaatttgatttaacattttgatttcgtagaactaaactaaattaatgaacaacctaactttcaattagggtatctttatgcaggacggaacgataaaaaaaaaaatcgaggaggggcaaaaatttaaaagcaaccataattaacttttactatcaataattattttaaactttctttgaaagaataattatttaaaacttagtctattgaaaaaactaaaatatcatatatcccattgttatattttaattgtaaaataaaatatagtgaaatagaatggtgtctaaataagttactatttcattgtttaaatatttttatgatgaaatgaaaaaaaagagtatttctatctcatcattctttaattaaaggaaaacatataaatgtaaaataaaataaatatattttatttcattccatttaaacaatacagtttattttttattatcgtcttattttaatgttattttgaataattaaataataaagtttgatatcattttattttattgcgcttcattctatctttctttctttttaatcaaattaatcacaagactatgggaccacttcctttttccttaattttcaatttttgcatgcacttttacagtatgaaaggcataagagagagattggggagctgcagctccctgttggaccattccatcaatcttcaaatgtggaaaaagaggtttgtataatgttctttcttcccatttttatttgtagattccatgctcacatgaagattacttttattatatctattgttttcctttgtcatttgaacttgaatgaagctccttctttcttttttttttttttttgtgcacacaccactgcaagaaaacagaggcacccagatataactatgttgctgctacgactggagtttgagttcttcattttttttttagataatttttttgtttttatctctagttactgaaattatccgagagtcttcattatatactgttggagtttgagtccttcattattaaaataaattcttggattgtaagtgatgataggataaattgtagccacaccattattttattctcttctaagcaaccacacgagatgggtttcatttccgaattttgaccctcccatgtattaataagttactcttgacaagttgttcgtatataaatctactttgattacttaaactagggagttgataacatatagatctactttaattacttaagctagggagtagacactagttattttttctttctttccatcaatcgtcaatgttttggcttaaggctaccagagataaaaaaaaaaaaatgacagaatcgaaataaataaataaaattaagcaacaacaaaaaaaaaaagagataatacgatggttcttaaataaccgtcttagaatgtcttactttctaagccggttatttaggaaccatctaaaatgtcgcatgttgatcaaaacatactaggacggttattgaataatcgtcttagaaagtaagacattctacgacggtacctaagaaatagtcttagaatgtcttactttctaagacggttattcagtaaccgtcttagatccgacgacatactaagacgggttgttactctaaaccgccttcgaaaatggatcattctaagacggctgtttactaaccgtcttagaaatctatattttctaagatggttgaaaaaccgttgttataaatatgatgctattttatgatgttgtattctatgacagttcaaaaccgtcatagaatgacaaatttaaccgacttagaatatcatatttgtagtggtgttaggctaatatttcgaatgatgctacttgttttccattgtccaacataaaaaaaaaaacccaaacgttagtaatataggaaagaaaaaattaagaatcaaggatcaataataacaccacgagtcaagacattttcatgattttatttgtgtatttttttatgattatccaactgaaaatattaagcaatactaagaaatatctggcaaagcttcttagtatataatatgaatgacattgaattataagcaatttaataagcctttgcctgagcctttttcatcttccaagactcggttggattctgacttgtagaacatggaaagaagaagggttcttggaatcattggactttgagaatgtggagacatgagaagcatcaaaggaggatcaagaagaatagattgtcgatctttcccaacttttcataggtaacaagttagcatccggtggtcatagtattaagctcttacactctatagtactggactcaattgtgagcctgtatacaaacacattagatggtttgtttgtttagctttatggctttttgtttgtgtaggaaaacacgaattcaactgttttgagttcaaaactctaatatgcctttccttgttttattttgcttatggtttttacttttttctttttatatactcactgccactttagtgttttgatgaaggatagcatttggtttgagcttgaatatacaatataaataatcaataatttttttttgttgtttataataattttatcatgttcaattagaattgtcttcccatgatatggtcagggagcagaaggtgaacttctgaaatctcaaataataaatagccttacaagacaccaacttgaactatttttttttctttccttttgatttttgtcgtgtatttatacggagtacaacacatataatactatatatattatatgcatatatgtgtgtgtggtcatacttgtcagttgcatttattatcttgaactgcaggtgtgtgtgtatttccatatatatgaatacgaatgggtcttaatttacactttattgcagcttgtaaaaagctgtgggtgtactgtatcataacaaaatacatgtcacaaggaactctgaggatatatgtatccgaacaagaaagagttgtactctctttcaatagaaactatactaatgttagctcttgacatacttaggggttatggagtatacaagaacaaagcaacatgagtttttaagaataaatctccattgacttagtaatgccacaacacttaaagagtgtctacctaaatttgatgttcttgtttctacaacttgtaagatgtcatctcattactttcaaaactgtcacttataaaccaatgtcaaaaaaaatatatcattgtatagtatatcgctggagcgtgcataacatcaaaagggactgagttcttggtgaggaactctggacaaatgattaacagaccacagagatttatgttggcttcccaaatttgctgaagctttcagagatgccaatttctggaggtggctaaacaactagttgaatgacgacattaaaacaaatcaagcagtagtatcaattgtagctcattatttggtaagcacagaccaaaatcatagcacctatcaaacccaaatctgaaaaaatgtagcatttgtacaagacattatacaatgctactactatgtatgtttatcattttcactctgaattatatttagcagtaagtcacatggatttggtaaaaaaataagggggaaaatgtaacgtgtgtgtaacagcatgactttgatatttacccaattttatatttttccctccagcaataatccccagagacaaaacttcaaaaatatttcagtatgaaattgcaataatgaagatcaattattgttagtggataaaaaaaaaagtgggtcccacactaattttaaaattatccacacaaaaggaaaaacatgttatttatcacattctatttttttcttctcccttccttgtatttttcagctgaaacaaacacaatgttacatctttgtacaatttcacttttcctcttgtcaagattaaagtctaggaatgctcatgagtcagttggatgagacatgataagttaaagttgagaatttacagctttgtacattgtcacttttcctcctgtcatgattaaagtctaggaatgctcacgagtggattgttggatgagacttggtaagtaaagttgagaagaacattcgaatgtctggtacaatgcaggaaatcatgcgataatacccgcaaattgaaaagttggcgacataaatatgattgaatgctcccagccacagataacaacagtaaaccattaaagtactattcgggcggtaaaaatttaacatgccatggtttcgacctcagtttaaaaaaattcttcagcataaacagtatacatgcatgttttaatgtagtaacatttgaattcttcgacatctggtaaactgttttaacattttccacatatatatcccacaagaataggttggtgagccattggataaaattaagccattgaaaagctttctacaaaagaaaaagaaataaaaatagaagcttttatctacctgagcaatagcttcttcacaaatactcttaaggccatccagatgatactcatatgtagcccttgagaggtcctaagcaacatccaaattaaaatatcaacaattcaatttcaaagacaaaaggtattatactagtttaaataatgcaactatgaaaatgtagaacagacggttcaatgaataaggaaaataaatcaaaataaacaaacgggaaaagcacacatatgagtaaaagtacctggggagttggtaatggaaaagcatcaaaaggagagactaaacaacttgctttggcagccaatttgtgaagtgctgctgaagcatcacccttctcctttacgcccttctcgcttgaagatttaagaatatccaatagcaattctaatcatgtacatttagcagcatattcattgcaaaatacttttaccatcatgaggagaagaaaaaagtttaaaatcatttattatgaaagaacatccaaacgttacaaatcatttattaccactattgtcaatgaatatagttttaccatcatgaggagaacataaataaacaagagcaatagttacacgtatttgaagccctttttctaaaaagcacataacagagattaggtgttccaatacctgccaaagaggaatagatacaaaaatcatatccaataacgtaaaaaaacatgaaaaaaatatcgttcaaaaactataagtagattataattctcaatttcacatctataactaaactaaatcactcacagaatttgcacgaaaactcactcgcccttgaatcttcttctctaatctttttaatgtgtttgctatgcaatctttcataggctgcaagttaaacgacaatcacaacaaggtgttctgttaaggaacattaataatgactaaattataatttaagaagaaatgcaactatatatggtaaaaatgaaaatctattactttaattacaaagagtagatgaacatacaactaatctttaaaatgtccatccttcggtttttgaaaaccaccagccataataatatctacaacaatgtcctataatacaaagatgttacatcagtggccgcatatcacattatcactgcacatcgatgatttctaaagggcagcacacaatgctgacaaagtaaagaacaaggaaattaacttcacctcattaccagcaagaccatagagggctaaagtagcatcacgttgaaggggagaattgtttgagtcaataatattgggcaaaggctctatagctccattttaagcaataacagctacgtgggtcctgaaatttgaattatatatgcaaaaaagggttatggaaggaaaaattataagaggaaaaaccaacatatatatatatatatatatataattcgtgaaacaaaggagcatattttttttacaccatttgtatacatttacctataaattaagaaaaatccacccttaagagttaggtttaagaaaggcaatcccaaattcagccataactaatgactgtagtgttagaggaatcctaaagcctacaccatggagtccccattcaacattaaccatttgtaagattgtgtagttatattatgaacacagccaaaggatggcaataaacatgttaataattgaatagagactatgattagcaatctatacctaagaatagcatcatggcttatcaaatattaactttaaataggagattatttgagaattttagatcaggctaattaattactgctatgataataaaaaatgcaatttgaatttttaaattttatattccttaacatataagcaagcgactaactttttgttgctactaataatcacctgtgccaacctcccaattgcaaaagccgacatttcccggagctctacatgtggagacttaagcatgtaaactaatggtggaatagcccctccttgggaaatatggaactaccacaaagtatggaagtcaataagaggatttcataactcatagatttatcatattacaagtttgcaatgcagaacttaatccacctttaaatctgaatttgttgcagcaaattgaccaagtaaaagggctgcttgttttttgcttttcaaacaacaagaactatcattgaaattatgaacttgcaaagaatacttggggggagaaaataactaaaccattaatatgaaggtagtatctgattttcagtaaacaactataatgttcaataaacatatcattcttctatatatggattgcttaatgattaaaggaaaaaccatgaccaaagtatagtgtaacctaagtaaacaaacgacaggtggtaaagccccggctagaagcacttctttcataatatctggtgacgagtggaccaaattttcaataacaacaacctacaaaaggcgctaatacaactagtgctagtagtttagaactctgtagaagcaaactaaaaaatgcatgcgattgtgtaaagtcatataagcatcttaccactacataacgtattataggatcctctgattgaagcattagtacaagagtgggtaatgcattgcatccaacaacctgcaatttttttattgcagaaagtcaactacctttgtggcattgaattcaagcaattcaacaagaggagggatatcaccttccttccagcatataccatacctatataagcataaagaatagaatagttgtagaataaatatttttaagccatgaaaaaaaggacaaaatcctgacacgggtcttattggtggtattttcaaagtcaagattgcatattgcatcagctactctcctgagaagaccgataactggaggagaaatggtactgatcttgtgcttacttaacaaatctacaagacaaggcaaggctccaacatctataatgagttgttgacgctctggttgtttgatgataaagataagaaaaaattaaaatcagagttaagatgctccatgattacgagggataaacaaacgtgacttgaaactgattttattcttaaacatatttttggaaccctcgtaccagaaattcaaagacacccataatcattttcctctaaaaaagggccacactattatatactactgaaaactcaaatagaaaacacatagagacgttacatgcacgcagtatggttgatgtatttaatccaatacacccatattcttcacttatatgttaatttggatagtaatttgtattattatttattcaaaaatcacccttaaaattatcaagactctccatctcactttttcatttaattaattaatgtgtgctagtcatgttattggatgcatccaagatttcatgggccgataacaaaaaaaataatttgtacccttttatatttaagtatttgaaaatataaagatatattatttaaaaaaagtggatacatagtttgattaaaaattacatttttttacattaaacaaataacataggtttaatgaaactcaaaatgatatatatatatatatatatatatatatatatatatatatatatatatatatatatatatatatatatatattgcatgtttttattcaatttactcttatattatcatctatcatttaatttattcataaaataattacataacataaatatttataaacatgacaatgggatgagtcgatgataaattaactatccccaacatttaaaaaggttgatttatattttttaaatctatctccattccggttgagttttataacttcgaataaagctataagaaactcatcacatcctttataactttaatttacttatatatttataacaatttaattttatgttctgtctatcaaagaaagtattctgttaggtcattattttttatcatcaacaagatatcatttcatattaaatatttcatatttttgttcattattaatatactaatgcttagttttttcatttataatttgaatttttagttgtttcttattttgttaaaaaataaatattttaagtttatgatcatatatcaattacacattgatatgttgtagagtgagctaaaaattcattcagtatgcccttacaaagataataaataaaaaagaaactaaaaactaacataataatattttttaagtcacacctcacatcttaattgaagaaaatgaacataaaataagataataattttaatttagttataaaagtaaactaaattaatataaaataatctattacactataattttgaatcccttttagggatgagtcctgtgagagaaatagtacattcaagagcaatttcaatgcattcgtccccttatatattcaataatgacaatataatatatagcattaactaagatatttagggagaaaaggatgagtagaacttaattactttaatagcaagaattacaaggatgtgtgcatatttgttctccacctcatgcttctcaatggtctgtcactactcgaaaaagcattttttacgatagtaaaacgatgacggttcctcaagaaggaaccatcttagtatgtaacgcaatgacaattttgtaaatatgggatcttagaaactacccttccacaacggttttgcaaaaaccgtcttaaaaaaccgtcttcgaagagaatatgtttttaatttttatatctccctcttgagagcttaaacatttgctctccctcactcgctctttcactctccataagcgagagccacagagacctctcactctcactctttccctctttccctttcaaatccctctttcactgattgtggtttttggtgctgcacaaccaaaacctgatatccagatccctctttccctttcagatctgaatgcgtatcgtccctcccatggcttcaaagcgcatcctcaaggagctcaaggacttgtagaaagacccaccaacttcttacaacatcgataccccttttttagtggatatggtgcttctctatcaagttttattctttccacttccaatccctaattaagtgccattattttccccttttcaaaaccagttcatttcgcttaccagtgttcccacaatcgaaacaaaagctttcccattttgcttcatcgtgcgaacaagctccacccaaccctatgtcgaaaacttaaacgttcgttgctcaaaattagactccaaagaaaagacatggccgcaagaacagttgccaaagacataatcactatttgcggttccgcaacaatcgttagtgagttcttcggtattcatatcatttttctcttttctcgctttcctccgatttctttgatttttgcatacctgtgtattttttgtgaacttttgcctgatcttttttttggtgattttttcaaattaggatatgctgccatcaagtttgatccttgtatcctgcattttttaatttattttgggccttattttaatatgggaatttgatcaacaatctctacaaccgtggagtttatccagaagaaagctttgtgaaagttaagaaatatggcctccccatgttgctaacggaagataagggtgttaaatcttttctagtagatctaaccactcagctctctggtaactaacatccctaatttgtttcttctgtcgtggttcttttttcatctcttggaagctgtagagaaatgacaataagtcattgtttagttggaaagtattgtttttgattaatttattcatagtataaaagttcattttaagaaatggttttgaatttgtcatcatttttcccaaactgttttgattttgaatgtgtcgcgctctaaatttgcatgacatattgtctttaactgagtcaattttgattaataaaccctttcttcactcctctgctttgtcaacccaacacctactcctgtgtgtgtgagtgactgagtgagtttgttgtaacaaccatgcttttttttttttaagttttcctataaaataaaattaataaattagtaaataaataagtaaaagtaattaggtcataattttccactatataaaccaaatgttaacctagagcagcttttataaaacacttctatttctttcttctttttctgacgcacaagaaccctatcagaacaaccagatgaggagctctagagagcaccagagatgccacaattgctaatggagaacgtttgagcgactacatcgaggtaagggatgagttactcacgcttgaggattagaagaacatgtataaggatttctagaggatcaattttggggtattttgggttgtttttataaaatgttaattcatgattctttcaaattgaataattcttacgctaaattgagtgtaatatctattgttatgaaattctatgatcctgttagtatatattgatatgatattttcttggtgtatattagatttttttaattttcaattgttattacttgatttcttgttgtatattaacgtgtatgattttcgttgttttgcgcttgtgatttatttttattttttgaatgtgttagtgaattgttatcattggaatgaaaaatttgacccaaataattgtattgtctattgtttgtaatgaactacaatttattgtcatctttttccctactattatatttggaagttttcaattgaaataagagttgttttccctgtttgggaatcgttgctttaaatttgccacaactcttttgaaaatagtgtaagacgtgtatgtaatacttgttgaaaaaaagaacaaaaaaaaaaaatgcaaaccaacaaattagttatacattgtttatagttgtcctatttgacttgacttagggattgattttagtataaaatattttgtagtctcaaaaatatgtttgttaaattaatggtttgactgcaccttttaatttcaaatttttaatttttcttgacaaatttgttaacaaactaatttgatagtctaacaaaattacaacagaaaactttgatacgttagggcgcaacaaatatgcttgatatgttactgttttctacatattaaattgatcaacaaattacaacataaacattctttttaaggtggaaaaaaatgcatacgttaatatttcttataaatgaatttcagccgttaaatattcccttcaaggtgcagtaataatatatttaatacgtttatcattaaagatattatacttgtaacacatggtttttgcttttaatatatatatatatatatataataaattaaatgttgttgtgaatgtattattttactgctctggagaaataaattaaatattttgtgacattattatttttttatttttttagttatatatgtataataataaattaaatacttttgtaaaattattgcttaatcataattatttttgccacatctcaaattaattgttgtagatatttttatttatttattttgttgaattaatatattcggttaatctatatttttattgtgtcaagtaaatgttactattgaatgatatgtgtaggatgcgtgagatgcgataaattattttattatgaaattgtggttgagactgtgtgtaagtgataatcatttagtacataatggattgtgaattacataattgttgagatgttctatgttttgagttgtgagccatgaattatgtaatcacacaactgtaagaccctttaagggcgacgagttaatgcgcaaagagttgtgatgagatccactgtgggaacccgacgagtttaatcacttgaggtgcactgagttaaaatatattttaaaaatatacatacatacatatatatatatatatatatatatatatatatatatacacacacacacaattgagtagttgtgtgcattgcataattcataggtagagtctatgtgttcaaatttttttttgggttagacctgaatcaggagggagaggccctgacgaactcttcggagtgtaggccttgggggtcatccgatttgagtgctcctttaagcctgtgccgctcccacatggttggagcattctcgcaaaacaacgtgatcctgactggtctccctatgatttcacttagtgaaagtgacctaacttacccattgtgaggcatgtcctgtcatgtactcttaggcgcccaacgaggtttttcactgaaaaatggtaccacattgcatgtaggcttaagtctagagtatttgttgcataatgcatgtgtttgactttcattgagttaacaattgtggtttgatgttattttctggagtggatgaacttgaatggatgtgcaaaatgtgtgtgattttgggaagtgatgttaattatataaattcagctttaagtattatatgttttacatgctctaatattttattatatatgaatgtgataactcattcctagtgtgtgtttgtgtttgggctgattgtcatttgttcaggtgagccatcacatgataaattccatgttagagccggagagacttagtctgtgatagagacatgctctgataagtgtgacattggggcataggattttacttcgcatgttatattttccgtaaacgatatagttgtgttatgttttctgttttagtttttttattattattattcattcagcatggacgaccttgttttgagccgggataactttgttgtttttattcgaacaatttctactatgttttcattaagtgaatgtgaaccctttatcttttgaaatcaatttaaagtcaatgtgtttaaaaaaaaatccgcatgattttatttccttttattcgttatttgtgagggtagagggtgtcacatttgtttttctcagctgatatatatggcgcttcatcgctccattataagcaaaacgacgtggtacaatgtcctattatggatgatggtggtgctcgtgagagtgcacggtgcagccgcgaggctgaaccgtaaggagtgggactcagtcataaagttaccgactgaaccggtggatgctgactcggatgaagtgggaacacgatgggcggttctcatggctagttcaaacggctatggaaactacaggcatcaagtaagttaatttggttttggtgtttttatttttttggattggtttaaagaccaaggtgtctccttttatttattttctaaaattaattaattagttttatgttttgagttgctatgtgtttttcattaatggttttgtttatggatgttgtgatgaattgaattaaattataaacaagcagatgtgtgccatgcatactagttgctgataaaaggtggactaaaagaagagaacatagtggtgtttatgtacaatgacatagctaccaacgagttgaatcctagacatggagtcatcatcaaccacccagagggagaagatctgtatgttggtgttcctaaggcgagtttttttttggttgattctctaacgtataatttaagctagcaaaattaagtgcttaaagagggatttccatagctgctaattaattatgctaccattgcatgtcattctttcttgtttttggctactctcttttcttttcttttttgaaaataaagtggtgcaacatgtctgttcaggaatgtgcgatttagactctttttttttatgtttttgaagtagagtaattatatattaacgttaatttatcacaacatcctttgaacaaggataaaaataggaagaaaatagagaggtatgtgaaataaaatggactatgcaatggaaagacaaaatgatttgggataatttagatcatgagaaagagttgtcattccctgagcatctcgtctcttgttgctacaatttttgtttatagctaacgtgccacctctcccttgttcagatcaatgatgctagtttttcctcttccccttgctcatctcaaattctgtgggtccaacccagattgccttgttctgattttactcctttagagactaaagtgaaagttatacccattgattagaaaatcaaaggttgagacttgagagatttaaatagctacatattttattaaacatttgtatgcatttaatcatgatctgacaattgattttttcaatcaaataactcatcactttactctttaaagtaagtccttcacttagcaacttccttttgttcacgacacaactctaaagccttcaaatatttttttttgttttagtttttctaccaatttactaaataattcttcttcactttctcatgcctgtaataccgggagggggagtgcatcttatgtttgatataatttcccttctgtcttgattttctttgtgctaggttgacattcattatggttatttccattgctacttgatttatagaataggcaaatataaacttcacatttaattaagaaaaccaaccatcattgaattatatggaaattgacattagtttatattatatgattattttgggtaaaagtaactaaaagtttaaaatttagttgaaagttaaaaacttagctagtaactaaaaagtgataagctagttttgttgaattaaaagtaaatttttcttagctagtttctaaattatttttaatagttgaaaaatttagattttcttttgatctagatattggtcttgattttttatgaaggcaaacgaccagttacacagatggtttgaagacaacaatgcattgagcgtgccattaataaggagtatgtctatgacccaatatgaacgaatatcatccttaggatattgcattccatatctatatatcacataactgttgtgtccttccttctcttatttatagctggattttattaccaggtggagatgaagcaggtcctacgaaacctatatgcctaagtcaagatgagattaaaccctgcacaacgggtacgcctttagttgctcatacttacaatgtagttgcataatcacatattctggtattgtatctattatgcaacacagtaaaacgaaaagaaaattacaagaacaaaaataaaaaaaagttaaattgcaagaatgaaaaatgtatttaaatcaaaaatatatatcgaaagaaattaattccttaaatagatttaagtattttgatacttgagcttcggactaagatacctgattccttaaaactgatggaatccaaagtttcgcttggagtgtaggaaagggaaacattgttacaaaattatatagaggtctggtcgtagagaggtcaactcttgcttgatatggtacctagttagtagtaatgcatcgcgtcaatatatattaggtgaatagctattcatgtatattaatatgatacacatgcattatagtgtgtcgtgtgtcttgtccaactttgcagtggtatatatgcaaataatagtcaacattaatgatatttgtatattattttttaattatattttcaactaataaagaagaataaaatacaatttaacattttttaccacataatatattaaatgaaagatagtacaataatatgaaggtaaaatagttaacacattaataatataaaataattatatagttattttataataagttttcatgataaatttattaatttttatattaattatgtaatttaaaaatcatacataatacaacactacgtctaagaacatcttatttttttactaataatattttatgtttggatgagtgtttgtaaaatagattttaattaaaatttattttcaagtaaaataatttatatttagatgcttttaaactaaaaaaattgctataaaaattaatataaattttttaactcaaaacaaaaactatttctaatcacttttagtgcacgtgagtgaagttccacctagaaggaaattacaaattataacttctaccttgcttatttatatttgatacaatttcattagataacatgcatacataattataactacattgtttaagacttcctattatgcttgttttaggggacaatattttttgttcctttttttttccttttttttccgtatctattagcatgcaaagtatatgaaataacatgtggttagaatagaaatctaagattgatggtaaaaaatgtatgaaattttagattttttttttttaaaaaaagaaacacattctaagataattctctaaataactgtcttagaatccttaaaatatttttttaaacaaaaaatacattctaagacagtttttaagagaaccgtcttagaatgtagagacattctaagatgatttttttttttgaaaaaaaccgtcttagaatcctcaatatatttcatttttttaaaaaaaatacattctaagacaatataccattctaagacggtttttagctaaaaaccgtcttagaatgatattttttaagatgattttctgtggaaccgtcgtaaaaagtgaagactttctaagataataattaaaaatcatcgtagaatgcccaaatcaaccgatgtaaaagctattttttgtagtagtgtgtggcagcgcccaaagatgcttcactagagcaaggacaacaccgtagttgctcaccatagtatccatgtaagaacccgtgataaacaaaatgtgaaatcctgcaagagcacaaaatatttaaacaaaaggcattattagtcgacgaaaaacagtaccatttttggacttatctagtgatggtgaggagaaccctcttgacgattggaggcggagtttgagaaatcaacaagttcggagaaaagtatgtgagattcttagggatctttaggatgtggaaaaacatcaagttcaaataaacttgttgagaaatcttcttccagggtataataatcaagatgcggctccatgatatctgtttggtcttcggaggcttccatggaattcacaacaacaaaattaattaaaaaagttggtgttagggttggagagagatcaaaacatcaaaatcatgcagacccttttatactgtttcttgcccgtcaaggaatgctgcacttaatcaagggagttcacccactcatcattggacccgacccaatactaaaaacaaaataactacttacagtacaaagaaacaaatcaataaaaaaaattatttatttatttttatatataaaaagttaaaatttgatatgtgaagaaattatttttcaaataggagattatcttaattagattgttgttacatatgaagattttatcatacatttattatgtacacataacgagattatatgtttagataataaaagtattttaataatttttaaatcggcaatttatgtggataaaattatttgatatacaattattttgtatatataaaaaagttgttgtatttgaaaatgctaatgataaaagtttagtatctgaaattttagtaaacaatgaaatcttgattttgttttgtgtcaaatttcaaatacacaacaaaatcatgattctattatgtgttattttttgtaattttgatttttcatgaatggttctttgcagtgtatacatggattgaaatacatcttttctgatgaagttacaatgccttagggttttggaaacatgtatgatgatagtcaaattgttttttactgtctcaatctatcaaatgaaatgcttgcagatcaatcaaataaaatgtttgcagatcaatcagataaaatgcctacagatcctgacaatgggttggacattgacctctccctaacctgattaccctaacttttccaatcatttcacaattgatgagatatgtagattagttgtcgattgattttatatttatgtatgtgtatgttgcttaagtgaagaaaaatattttattttttaggtttttgaaaattgatacaatttgttcggttgggtttgagatttgtggaaaagtcttcgatttattcttgtcattcataggtcagaaaatggaaggaaaatttatgttgtagtgggtagtgaaaatgaaggaaagtacaagcaagataaggataagttagtttgcaagagtactagaacaaaaaaatgtggttgttcatttaaattaaaagggaagtttgtcaaacaagttggttggaaacattttgttgtctgtggtgttcataaccagaaagttagtgaaacattggtcgaacatgcataggttagtcatttaagcagtgaagaaaaaacttttgttgacaacaaagatcaagataaaaaaaaatgtcaccaccatcaagaccatatataatgaatgacaaagatatcagcgaaaaaaaaggcactactaaaaaaatagttttttatgatgcacctttgacgaaggtccccaaaaaccgtcttagaaagtcagaaagtgaaaattttgtaaatatgaggtttttcaacaaagacagttttgaaaactatcattccacgatggtttcgcaaaaatcatcttaaaaggttttcattctaagatgattttgtaaaaaccatcttagaagtgagtgtgtttttaatgtctctccctctagtcttttctcaatgtccctctcactctccaactccccctcttctttgattttgtcacaataacccatacaattcaatttttttagggtttccagcgactgagggattggaagaaatgtagcaatggttgaagattggaatcagtagcagcactcttcaatgtgttttacaccactcagaacaccttctccggcttgcacgtccgtggaccccacgacttcgaccacaacacatttttcacgatctagaacaaaatcaccgcgatcagaaggtccaacaacgcagaaaggtgcagtcgcgcgccaccaaagtgtcagtcatggaatcgcgaaccgatgggaagactggcggttaggacaacatggaggttcaacgggaacatgaacccaaactcggcctggacacgtgtaaactccacgtcagagagaccatgctgcacatgtatgcttgagttgcgaaggtggtttatgaccttgtttgctaaggaagtgaatgagacgacatcgttacagatcaggacagacggggctgttgttgcttgggccaataaccgacttaaatcggctatatgggtcgggtttagaccgatcatcctccaatccacatctaccattggccaatatatacttatacagtgaggaggtgggctcttttctttttaaattttgttttttttttgtttttccttttatgggttttcaagaagttttgattttgagattgggaacttgtgttgcagcttcaacttggagtggatgaaagctacaatttgttcgtttgaagagcccaaaccctttctggtgttggggaagtcacaattgaggtgtggtttgtttttatatgactatttgttattccattactagaaaagcctctttggtgatagttatttgagacatacaacgacggttttgaaccttctttaaagttaatgtcataaaaagtcaacactttccatgaccggttccttaaccgtcttagaagcataactttctaagacaattttcacgtgaaaacagtcttagaatgtatttttttttaaaaaaaaaattgaagattctaagattgtttttacgtgaaaaccgtcttagaatgttttattttttttgagaaaaaattaaaaaaaatgaggattctaagacagtttttgggaaaaccgtcttagaaatgtcttttttaaataaaaaaaattgaggattctaagatgatttcctaaaaaaccgtcttaaaaggtagactttctaagatggttttctccatcttagaatgtctttttttaaaaagaaaaattaaaaaggccaacgaattttgtaaagaaactaagacagaaaatgatcatgtaattgttgtcttttttatttattatgtactctaagacaatttaatgttaacagtactacaatacatctgactaattaggtagagtgaactatttaaatttaaatttagtgaactatttaacaatttatatactatctcctaaacataagataagagcatgtaccacagtttttttgaagataaacataaatgcttaacccaataaattattttgaatgaacatggtaataatttaggtaacttattttataaatggggaaaaaagtattgttaaatgtatgtttacagctttgacaagaacaatatcatcaaagaatcaatccataggaattttctaccatttcaatacaacaacctacattttaattaagagaagctataattacacaaaatatcatttatgttcacgacaaaagaaactagattaattcattaattatgataattaattaagctaattaaggcattgcatgtgcttataatcaaaggagcaaatgggagccaataataatacaaataccagcctttccaacaatttggcacttccacttgtaccttttgaagctatatattaaaatacttgtgttatctaatatttactacaaataatgattcaaccaatagacaattgtaaacaatcccaataaatgtgaatgactattatcacaattactttgttaatttctaatttggtaaaaaaatactttggtaccttgataaatattgttgtttctgaacacaccaataaaaataataacaatccgatctctcatagcatgcattgatctcattcatacaacacagcaaaaaaaaaaaaaaaaaaactcaataacaagttaacaagtaaaaaacaacacaacacgaaagaaaaaaagagcaattcaacataaccagacaatattcttttatggatttatgacaattcccccttattatgccaaaagaaattccattatttttgtctattcttttcatgtactaataattatccaaaaaaattgagaatagccagtgcactagaagcatttgagattggcaaatcattataggccatttatatttcaccaacttatgggtcagaaaaacatgttgctaggagcaataggaacaaaagcctcctcagtgacaagtttattcaagaaaatccacaaaagttacatatattaagtgatctatcaaaatcataaagaaaaaagaaataaatgaaatgattattatgaaaaaataactagaaatccttataccataaagacgaacacccttatatatgagaaacatatatatttagtacttttttccttttaagaaagattaatctcaagtcatataccttggggggtttgattccaaccctgacaaaaatctcaagattcattaaaaaaaaaatactaccttagcattgtgctggcactcacgatttccaaataaagccaatgaatcaacaacaacctttgatggtttcccttgtactgaaataggagaataaacctgagtattcaatttcgtattctgtagataagcatttgctattgagaaataaataatttgtattgtacaaaatgacaaaaaaattacttaccaaaaattacaggcaggataatcagacaaacaagagaagccatgctcaccagaaatgaacaacccaatgtattcaaccaaatgcctaaaataaaaaaaaacaaatgaactatataaacatcaaatctgaaacaattcatagatttgagcttccagaaagctagaatagcattaacaacacacatcttattttattattgtccattttcttatccaaaaatataaatgttataagggaattgcgttctatttgaaatgtttgaagaagaaaacatttaaaagataatcttaatctccaaatcaaaaagtaatagtttccaaatgtcattatgaatgggacttttcatttcctattactaagatgaaaagtctacttaaaggaggctgcttttaatggatagaaattcgaacaagcttaatggggggagaaaagcattcaatggaaaatatttaaaataaagttagtcctccccaacaccatttattatggcaaaagctagtatatagggaaaccatcttattttggggcgaaaaaaaatcaatttgcactctcagagttcattacctacatgagctcaagcttccaagcgacataggtgagaatgtcgacaaggtaggaaatgatgagtagaatggtgtcgggggagtaacggacgagaagcgcaatgatggcatgaaagagggagaagttcctctagaggaggttgaggcgtgactcgccagggatctagcgggcgccagtgatgacgttgcagaggtcggagccggtggtgacggaggaatcggtggaggcgttgatcttggtgcgatggaggaaggcgacaatgttctgaaggttgagcatctcatcgtagagcttgtcggcattggtgttgacagggacgaactcatcagtgagaagatgattaaatttgttgttattgcaaatgtagaagggaagggaagatgagggtttcacaatagagagagcaagagaaagaaagtgagaataagagagagagacctgataagataagagagagagagagagagagagagaaagcgtgaatttgaaaaggcaaaaccattcaaagacagttttgtaaaaccatttttgtattgtgttcaattacgacggttttttgaataatcatccttaaattcacaattccaagatggttatttgaaaatcgtcttcgttattaatgaacttaattatgacattgtcaccacattgtcttcaaagatgatttttgtcaaccatctttgttggcgcatcgtaataaataatttttatggtagtgtttgttaatggatttgaatattcaatgagattatgttgtttgttggctaatggatacttaaattctgaaggttatgttgtacttttcccttcctaagttaaaactagtttccttttatatatgtatttcttagtttaatgtcgtaattttctgtgcattgaacaagttaaccaatcccatcaacaccattctaaaatgccacatagtagcaattggaatttgttgaaacacttgttcattgagtgttttgtttttagggaaacaaactgattgataaagaagactcttatgatgttgtgcttcctttcttatggttaatggacaaaaacaaataaattgcaatatgtggtttatctttttatttctttaatgatagtcatttctaattggccattagtcttttaagttttttgtgattttatttattctaggcaaatactatttttggtgcattgcgtggattagaggtatgtagggaatttgcatcacaatcagctcaaaattctcttctttgtcctctttactatttagcacaaagtggagggataaaaggagttgtacatactagatatttttggataaattctgttttttattttttattttttagataactttcaaatttgtgtgcaatctcatttttcataatttaggtctgtgtgcttctctatatgattggtcaaatctgtaatttgctttattcatgtctattgggcaagatgtcaacagttttaaagaatgtagttcttgtcactcttaattagtgaaattatgaactagcattaacatatataactattggtatatacatagtaagttgcttaaacttaattttattatatattttttcacctttaaaatgaaagttgaaccattactattgttgtgtttctcaatacgcattgcggacaaaagaatcactaccttctgaaagatttaaagaagtctaccttttttttcatttgaaatgcttctactatcgaatattacacaatatagttagggataggatgagatactttgcaaagaacaaagttcaggttaatccagagatttgaatgagagtttcaacttctagatcaggaagacttggagaaacgttgaacgaaggatgctgatttttttttattataatataaatttataacccccttttctatggatggatgcattttatctaacaagtggaccccaaagtagttgtcattgattaagaaacataattgttttatgtgtaaaattgttatgccatttgatcaatgcttatccattattagaagtactttcaagggaatttcttgtgtgactgcttattgcccattctttcttatttaaatacttgattccttgtggtttaatggatcaaaattcttcaaatataaatcttgttcttatttagtttgattatattaggcttctaggatttgtatcctcacggttttttcccctcagaccacaatgtctgctatgtagggaagggcctactaacttatttgagatctatttttctaagcataaatttataattaaaaagtaataacctatttttaattattattgtgattaaaattaatgaatttaattattatttatgattgaaaaggtgaaaaaaactaattaatatactattttctcttttttcaaaatataaacgtgttgtggaatgggttgtaacaaggttcttaatctgctttgtgtcttcatcttctttgtctttttgtttatatctcctttagatctgtgccttctttccactaggtaaggttcgagattacttcgccctcgttctgtggttttcactaagtgagtgctctatggtgcaactatgcaaattttaatttatattctttgtggcaatgtttggactaattgttttagaatattagattagtttattaattgtttttttgataatatcttgcaattgggaggttgtattttcttgatacggtaaatcagtgataccaatggtgtaatggtctattctaagtaataaactttaccttataaatctatcaaggatttcatttttgacattgttattattttaactttgaatatgcttttagatattaagctaatattttgtttcaaagataaagaaaagatagaaagtttttatattattattcaataaaaaattattatatacatgataataagtttattgatttttataaaattattttaaaaatcatactaatgatcttttataatttgtaagtagatgaaagtcttacaatgtgagtacttcattattaaaaaatttattagaggatattttcattcttgattaattaatctttgcaatttgtttatggttacagggatgaggcatcctgatcttcgtctgagatgcttagttctacattgcccagcggtgatgaatcaacctctttgagtagtgtattgaagaggcatcgagttgatcagcgaaattattgacccttggttgaaaattgaagaggttagaggtggtgaaggtttattttgatgaacccaattcgattagaaattaatcttgaccgttgaattgatggtgataatttaattacaaattatgttaagtgctaactctcatctttctcttgaaactacttagtttataggacaactttaatttcagaaaaatttagtttgtttttcacattcaatttttgtagtcaaccccattgataataactttgtagttcacatttcatgatatatatgtatgtggagaatgtatatatttcaaatcctactacattcatttccatgataagaaaaactaggtagattttatataaaaaaattatcatatacctcctttattattattgtaaattgtttgtagattcacatatgcaaaacatataatcttttattatatttataactttttaattatatttaaataaaaataaaataattttaggtttatattttactttcaatatattataaacaatgattttgtttccaaatagaaatattatatttttaaataattaattcataaataataagcctcaataaatttttggtttgtttagagactttccaagataattctttcagaaaaatgtcttagaaatatcatttttttaaaacatttttaagacaaaaaaacacattctaagatggtttaaaaaagaaccgatgtagaaatcaagatgctaagactgtttaaaaactatcgtggaaagtgttgactttccatgatggcgacttcaaagatgatttttgaaccgtcatgaaatgtactaaagaactgatgtgaaaaatgctttttctagtagtgaggggtccatgaacgaaggtacaacatctactaaagttgatagagcacaatcaatatgtatattgattcaaaagagtggacactcaagatgttgtcaaagatataatgtagtctcatccatatttcatcaagctattaaatgcattcccacaatgttgatttgtgatactacttggaagacgaacaaatatcatcttccactattggagattgttgtgtacttcaacagaaatgatttttttttttgcatttgcttatttacaattttagaggatgaagaattttgaatgggatttaaaaaaggtcaaaggattgtttgtgaaggatgatatgctgcctcaggtgattgtcactaacaaagatcttactttgatgaatgcattggaggttgcctttccttttgcaaccaacttgttatgttaattccatgtttctaagaatgtcagagcaaaatgcaagatactcgtgactaatgcagaagactgggaggttgtgatgaatgcttgggtaggattggtgaattctattgatgaacaaatatatgagtagtagttaaaaagctttacaagcatttgtagacattatgtggattttcaagagtatatttattatacatggttgttgcattatacggagagatttgtacaagcatgaactgattgtgttatgcatcttggaaacacaactaataggtagatttttgtaattacttacttgtttcacattttgtttgttatgtatcttctattgatattacattaaactactttacagagttgaaggcgcacaagcaagactaaagaggttgtttcatgatagcataggagacttgtgtatttgctgggatgcaatgaataacatgcttatactgcaacatactgaacttaaggcgtcatttcaaaaaagcatcaacgtgcttgaccacaagttcaatacaccgttttacaaaagactacgaagcacaaagttttaattgtgttgaagcgctttgcttccattagtgttgacagttttaattgtgactgcacactcagaactattcatgatttaccgtgtgcctataaacttgctaggtatagccaaatcaatggttcaatacccttgttgtccattcatgtgcattggaagatgttattcatcaatggtacacacaacgcaggtgattcttggggggacttaactctcacaaatgaggttgatgcattggtaaagagattttcatagcttgatgtgagcataaaaatgacattaaagaataaggtccatgaacttgcattttcggataccactttaataagtttgcctccaaagaaagtaaaaacaaagggtgcattgaagtctgtgaaatctactaaatgtgctcctttaatgtgagaacgagttggtgaaacatgatggttggtagtttgagaacaccaagtgtggctcgcaaagaagtcagtagcaaaaagtggacaaaaaaaaatcctttatatgaatgaattttccctatctgttgcaacagttcatgtaaaagttgttgacattagacctaatggaaattgtggttataaggaaaatgcaaccttacttgttatacaagtggcctcaataacttaagaggggggtgaattaagtttaaaaaatttcccctaacaagttttaattctctctttaaaagaaatatgtagacttaatatgcaaaaaaagaagtaatgaacaatttccttgatgcttctttaaatatgcaaagtaaatattaaactgcaataaagtaaaagagtttagggaagagagaattgcaaactcagttttatactgattcggccatgccctatgcctacatcctgtcctcaagtaatccacttgagatttctactatacttgtaaattcctttacaacttctgaaccacccagggatatccttcccttgtgttcagagaacttacaaatcaagagacccactgcctcttgattacaacaacaaattgcttttgaagtacaaaagatgtttttctctctttaagagaatgatacaacttgaagaacttataagaatccttaatgattttgcaagtgtttggccaaaggttttcttgtgagagaataggacaatgaatgttctgaaaaattctgaagaatttcgaacacaagtcacatatttataggcctttggtgacctttcaaaaaactttgtgaagagttgtgacttttcaaagttatttttgaaatttcctcactggtaatcaattacagatatgtggtaatcgattaaacaattaattttgaggaatcatgacttttcaatttaaatttcaaaaacttttgtgattggtaattgattctgaaagctttttgaaaaacatttttgcttctggtaattgattacaacaggctgtaatcgattaccagagagaaatacataattttcaagatgtaatatttacttaaaaactttataagatatttgaaaacttaagtcttttaaggccaaacctttgtaacctttttaagagattcttttaacatataaaggactattgtaaattgtttctattgatttcttgatcttgacttgaatcaacgttgaatagctttaatcttttggcatcatcaaaatcttcatacaacatatgcacttacaatctccccctttttgatgatgacaacaatctgaaaacaagataaacgatattcgatttgcaatgcatgcactcacccttactcccccttaaatttgcaatttattgcctagttttagataagatccacccttagtttctctacccttaggaaacatcaaaaagctgaaaaagacagaagaaaatatcaaagccacaaaatatctagagcaagcatcacaaccaacaacaaaaactaatcatccatagcaaaatataaaatagaagcaagtgcaaaatattcaaagcaaggcataaaccgggccaaatgctaaatatccaaagcaaagcacaaaattaaccaaagtgataaataacaaaatccaaatacagggcacaaatagtaaaatgtctagaaaattaaggacttataatactagaaacgtctaagaatccgtaggtgatgacaaaaaggtgattcaaaggtattttgatgataacaatgatgataacaaaagatggtgacaaagggtgatgacaaaaagctcaaagatcaatcaaagaacaactcaagtgaatcaagaacaattcaagagttcaagataagaatcaagaagaattcaagacttaagaagaaagtttagagtcaagaatcaagatcaagattcaagaatcaagagaaggcttaatcaagataagtatgaattttttttttcaaaaattgagtagcacatgatttttctcaaaacatgtttaccaaagagtttttactctctggtaatcgattaccagattgttgtaatcgattaccagcagcaaaatgtttttgaaaaagttttcaaattgaatttacaacgttccaattaatttcaaaaatctgcaatcgattacaatgttttggtaatcgattaccagtgcctttgaacgttgaaattcaaattcaaatgtgaagagtcacatcctttcacataaaagccttgtgtaatcgattacactgatttggtaatcgattaccagtgattgtttctgaataaatcaaaagatgtaactcttcaaaaggtttttgactttttcaaattggttttaagtttttctaaaagttataactcttctaaatggtcctcttggccaaacatgaagagtctataaaagcaaggctttgattttcttttcaatacactaattcatacaatcctttacaagccttgaatctctttgaacttcttcttcttatttgtgccaaaagctttccaaagttttctggttttctaaaccttgaaaacttgtgctattcatcttttcattctcttatccctttgccaaaaagaattcgccaaggactaaccgcctgaattctttatgtgtctctcttctcccttttccaaaagaacaaaggactaaccgcctgaattcttttgtgtctcccttctcccttgtcaaagaattcaaaacgacacagtctgagaatttttttgattcttccctttcccttatacaaaagtgttcaaaggactaaccgcctgagaattcttttgtatccccattcacaaagtatcaaaggtttaacagcctgagatctttgtcttaacacattggagggtacatcctttgtggtacaagtagagggtacatctacttgggtttaactgagaacaagagagggtacatctcttgtggatcagttctagtggagggtacatccactaggttcaaagagaacaagggatggtacatcccttgtggatctttgcttgtaaaaggatttttacaaggttgaaagaaatctcaaggaccgcaggttgcttggggattggatgtaggcacgggttgttgtggaactagtataaaaactcttgtgtgtttgtctccttcttccctactcttttaatttccactgtgcattttaatttccgcttttacttttggttaagtttctcttctactatttattctcttaacaacataagtaaaagccttagaagagtaaatttttaattagtaaaggtttaagaataattaattcaaccccccttcttaattattatgaggccacttgatctaacacctgtaactcaattaggacgtcattcaataaggaagaggaggtatcttgttgcggtggtagagagggtgtgcgttcatcgagaatgggaggtggcaggtcttgtttatgttggatcaagtggtctcggaataattaagaagggggggggttgaattaattattagtgaacctttactaattaaaaatctatccttcttaatattactagattcgattaggcttttactataatgttaagaaagtaaagaacaaaaatagaaacttaaccaaaagtaaaagtgataattaaagtgcacaatggaaattaaagagtgcagggaagaagaagacaaacacaagaatttatactggttcggtaacaacccgtgcctacatccagtccccaagcgacctacggtccttgaaatttcttttcaaccttgtaaaatcctttacaagcaaagatccacaagggatgtaccctcccttgttctctttgaacaaccaagtggatgtaccctccacttgaactgatccacaggagatgtaccctctcttattctcagttacaacaacccaagtagatgtaccctctacttgtaccacaaaggatgtaccctccaatgtgttaagacaaagttctcaggcggttagttctttgaaactttgtgaaggggaaacaaaagatatctcaggcggttagtcctttgaattcttttgtttaagggaaaaggaagaataaaaaaaattctcagactatgtcgttttgaattctttgacaagggagaagggagacacaaaagaattcaggcggttagtccttcgttcttttggaaaagggagaagagagacccaaaaagaattcaggcggttagtccttgtcgaattctttttggcaaagggagaagagaataaaagatatagcacacttctattttcaaggtttggaaaaaccagaaaactttagaaagcttttggaaaggaagaagaagaagaagaagttcaagaaaatgttcaaagaaattcaaaggttgtaaaagaatatgtggaaaagttgtttgtaaaggttgtcagtattatttcaaatgcaaatcaaggtcttgcttttatagactcttgaagtctggtcaggaaaaccattgaaagagtataacctttagaaaaatctgaaaaccattgaaagagttacatcttttgatttttgttcaaaacttgtcactggtaatcgattaccaaatccttataatcgattacacaaagcattttatgaaaggatgtgactcttcacaattgaatttgaattccaacattcagatgcattggtaatcgattaccaaaatcttgtaatcgattgcaccattctgaaatcaattggaacgttgcaaatttagttgaaaaattttgaaatcaaactttgccactggtaatcgattacaggaaattggtaatcgattaccagagagtaaaaactctggtaacttagaaaatttgagaaaaattcttttgaaaaacaaaactgtgctatgtttgtttttttgaaaaatcttttcaatacttcccttgtgaagtcttcttgatttcttctcttgaatcttgaattcatcttctcttgaatcttgaaatcaaacttctcttgattcttgaattgttgactcaatcttgaaatcattctcttgggctttttgtcatcatcttttgttatcatcaaaacatcttgaatcaacttgattcatcatcatgaagcttgcttctacagtttatacacccattggccatccatatccttctggtatccgaaggaggtaatagcaccaacaccaatagcaaaggatcttttaaccttaacaaaaggttcatcctctaaaagaacattgaaatgctgaagaaacaaagtgacaagatgaggatatggaagaggtgcattgactcgtaatgccttatgcatttggtacctaacaagatgggcccaatccatttggcgaccgatttgaagagcccatagcaagattaaatcctccttaaaggcttgagcaagattggtgaaccggggaagcaagactcaaaaaaggatataatgcatgatgcgacactcaaaggtgaatgagctagcaagcaatctaccggtcatatcagtatggtcattacagaccattttacgagcatcatgactagaataaacatgcttccaatcatcaactagagtgccttcaaaaggaacaccctgactgctcagtttagtcagagaataaaatagagattgatcaacaacaataggtatttgatgcacctcagaaaaaatgacttcatcctgaattttaagattattgtaaaagactctaactaattcaggataatatggtaattttagagacataaactcaactaattcagaattttgaaacacttgatagcaatcaaaggtttccccatcaaagaattctacatctaaatacttaggatcgagaatggcacaattggagaattgggaatagtacctttgaagttggtcattggaagaaaatagagtcaatgacttgggagatgaaaaagaagggggttttggtgctagtgggtcaccggatgtgccgtggcagtgttggcctgcagtggtggtggtggaggatgagtcctttctcttctttgcgggttttgcaatttgagctttcttaagaaaattatgatcagtggagtttgtagagaattgaaaaagaagaaatttgagctttgtttgaagtgatttggacaagaaacgagaaagttatggtgatttgaagttttgagaggaaggggcgccgtcaaggagagtgagggagaagagggttgcacaaggagagagaaaaatgcagtatttatagacagggacgagctgtaattgattatagcccatgataatcaattacaagcgtaacctatatctgaccaaaccctctagtaatcgattacagtctattgtaattgattatagggtcatgttctatggtaatcaattacagggagtggtaatcgattaccagaccctaaaaacatagatttttcattaaaactaactatttttcactcaaaaaacttacacactcagtataacaatcatcaacaacaatcaacaatcaaaataatcaaaataagcataaaaactctcaaacacattcatcaaagacaatcaaaatttcaaaaataatcatcaacaacaaatcaacaatcaccataactattaaacataatcatcaaagacactcaaaaactcaagcaaaaataatcattaaaccttaatcaacaataaatatcaaaagcaaacacaatcagcaaggacaatcaaaagttaacaacccaaaagaaaaaataataaacaaacaaattaactatttatctaagtcattgatatctaggagtcctaattctcttttaataacaaagaatgtttctttggggagaggttttgtaaagatatcagctaactgattctttgtgtcaacgaattctagtacacaatcccctttttgaacatgatctctcaagaaatgatgcctaatctcaatatgcttggttctcgagtgcagaataggatttttagataggtttattgcactcgtactatcacatcaaataggaatatgatcaagaattaatccatagtcagaaagttgttgtttcatccaaagtatttgtgcacaacgactgccagaagaaatatattccacgtcagcagtggataaagcaacactattatgttttttactatgccatgaaactagagtagagccaatgaaatgacaagttccactagtgctctttctatcagttttgcatctgacaaagtcagaatcagagtatcctattagattataagtagaatttttaggataccataaccctagattaatagtgcctaatagatatctcatgattctcttaattgcactaaggtgagattctttgggatttgcttgaaatcttgcacacatacaaacactaaacattatatcaggtctacttgtagataaataaagaagagatccgatcatacctttatatttatttatgtctattgactgactgatttcatctatatccagatagcaagcagtactcattggagtagtcatgtgtttagcattttccatcccaaatcagtgaatcaggtctttgcaatattttgattgactaataaatattccattctttgtttgcttgatttgtagtccaagaaaaaagtttaactcgcccatcattgacatttcaaattcattttgcatatcttgcgagaattatttgcaaagagaatcattagttgacccaaaaatgatatcatcaacatagatctgtactaagagtatataattcaattttcttttaataaaaagggtagtatcaaccttagctcttgaaaaacccttttctaaaaggaatttactcagacgttcatactaagccctaggggcttaaaccatataaagcctttttcagtttaaagacatgattaggcttttctgagttttcaaagccaggaggttgatccacatatacttcttcttggataataccatttaaaaaggcacttttcacatccaaagtttgaagtccattatggatgcaaaggctaataacattctaatgacttttaatctagctactggagcatatgtttcctcataatctattctttcttcttgattatatcctttggctactagcctagccttatttttaattattattccatgttcatctaatttgtttatgaatagccatttagttcctataactggatgattatcaggtttctcaactaattcccaaactttatttctttcaaactgatttaactcttcttgcatagctatgatccagtgttcatcaattatggcttcttttaaatttttaggttcaatcaaagaaacaaaagccatattattgcaaacatctttgagagagtgtctagttgttacccctttagatatgtcaccgattatgttgtcaagcggatggtatctagaagttcttcactctcttagaagatttgtacttgtttttgtttcatcaatttgaaatttttcatcatttccctttccttttcctttgtgctcttcaccatgaatatgcataccttctaaagaatctgaaaaatcatctagagtatcctttctaggcacagttgagttagtttcatcaaaagcaacatggatagattatccaatgatcatagttattttgttataaattctaaatgttttactgtgcaaggaatagccaaggaatataccttcatcaaattttgcatcaaacttacctaagttctctttgtcgttgtttagcacaaaacatttacatccaaacacatgaagatgagaaatgttcaattttcttctgttatataattcatatggagttttctttaagattggtctaattaaagctctattcattatatagcatgcagtatttacaacttcagcccaaaaatatttaggaaggattgcatcattaagcaaagttctgactatttcttctaaagatctatttttcctctcaactactccattttgttaaggggttctaggtgcagaaaaattgtgtccaatgccattttcatcacaaaatgattcaaaatccttattttcaaattatcctccatgattactcctaatagatacaattttgagatttttcttattttgaataattttagcaagtttcttgaaagcatgaaaaacacctcttttatgagtgagaaataatgtccatgtaaatcttgattaatcatcaactataacaagagcatagtagtttcctccaaaactcatagttctagaggggccaaaaagatccatatgcaaaagttgtaatggttgagttgtagacacaatattctttgatttgaaggaaacccttacttgttttcctttttcacaagcgtcacataatctatctttttcaaatttaagttttggtaaaccaataactaaatccttagaaattagtttatttaaatgttccatgtttatatgggcaattcttctatgccataaccaaggattatcatctttactaagaaaacattgatcatgatttaatgttttatttaaatttatcatgtaaacattatttaatctatagcctatatgttttatatttctatcatgtttgttttcaacaacacagttatgagattcaaatgatactagatagcctttatcacataattgattaacacttagtaaactgtgcttaagaccatcaacaagtataacattttcaatggaggtagatgaattcatacctatttttccgactccaaggattctacctttattgttgtcgccataagtctcatgtccactattcttgggagaaatatgagtgaactttgatgcatctcccgtcatgtgtttagagcatccactatctatgtaccaactcttcttcaaagaaacctatatgatcatgtttatgacttaggtacccaagctttcttggatccttgaatgttagttttgataaaaacatccttttggaacccatatcattttaatattattattatttttcctaaaatagcatgtagatgcaccatgtcctttctttctacagtaaaaacaagttaagaaaggagaactattcttttgattggatgcaaagaattttttatataacttttgttgtttatcaggtctatatcctaatctagcctcatcaaacacacatctttgctttcctaatataatatctagattatttttgccaacaataaatttggaaagagaattttttagatccttgatttcttctataaacttgctacaacaattacatgcttttttactatcatttattacttttatggtggaagattgatttgtgccaattggttttaaagttttgacttcagttctaagattttctaattcttcatttaattttaaaacttccttttctaattttgaaatagttttcttagaaaatgaaactagttttgcaagtttgactgattttttatgtaaatcaatgaatgcatcttgaagttcatcaaaggaaatagataagttattgttagaagatgttacctcttcatcgctttcataattttttaccatcagacttagattcacaacttcattttttgagtctttggatgaatccatatcgttgtcttcccaagtgatgtaagccttctttgctttcttatcattgaaggttttcttttcagatctttctattcttttcttgaaacttgggaaatcaactctcagatgtcctcgttgattacattcataacactttggaagagagggtgaatcttctcctctttttttttggtttgaaatttgatctttttttatttcctttgtttcttaaaaatttattgaacctctttacgaagaaactaaaatcctcatcttcctctatttcattcaaatcttctttatcacctccttcttgaattgaagatgaagctttaagtgcaattcctttctttttcttgccattttcctcatgttgatttagtctcatgagttccatttcgtgttcctgaagttttccaaacaaagttgcaagagacatgttaataagatctcttgattctgtaatagccattacctttggttgccatttcctgcttaaacatcttagaactttgttaataagatccttattgggaaatatctttcctaatgatgcaagatgatttactatgtgtgtgaatctcttttacatatcctgtatagtttcattttgattcattctaaacaattcatattcatgggttagggtatttattctagacctttttacatatgttgttcccttcatgggttacttgtaaggtatcccacatttctttcgcattcttgaagtttgatactctaaaatattcatccaatgccctaatgcagatgtaattatatttttggcttttaaattatattgtaccatttttctttcctattcatcccattgttccctaggtttttctatagttgcatttcctgctaccatagtagggatgtaaggactaatttctatggcttcccagatgtttaaatctatagcctctatgaaaatttgcattcgggttttccagtaatgataacccacaacattgaatataggaggcctatttatagagttctcttcgggaaataaaaaatttgatgaggccataactattcttgaagtttctaaaccttatacaagaattaagctctgataccacttgttacacaagtaaactcaataacttaagagggggggggggggggtgaattaagtttaaaaaatttctcctaacaagttttaattctctctttaaaagaaatatgtagacttaatatgcagaaaaaagaagtaataaacaatttacttgatgcttctttgaatatgcaaagtaaatataaattgcaataaagtaaaagagtttagggaagagagaattgcaaactcagttttatactggttcggccatgtcctgtgcctacgtccagtcctcaagtaattcacttgagatttccactatacttgtaaattcctttacaacttctgaaccaccttgggatatccttcccttgtgttcagagaacttacaaatcaagagacccactacctcttgattacaacaacagattgcttttgaagtacataagatgtttttctctctttaagagaagaatgatacaacttgaagaacttataagaatccttaatgattttgcaagtgtttggctaaaggttttcttgtgagaggataggacaatgaatgttttgaaaaactctgaagaatttcgaacacaagtcacatatttataggcctttggtgacctttcaaaaaaatttatgaagagttgtgaatttttagagttatttctgaaatttcctcactggtaatcgattacagatatgtggtaatcgattacacagttaattttgtggagtcatgacttttcagtttgaatttcaaaaccttttgtgactggtaatcgattacacaatagtgataatcgattatagattttaaaattcaaatttaaacttttctgaaagttgtttaaaaaacattttttcttttggtaatcgattacagcctctagtaatcggttaccagagagaaatacataattttcaagatgtaatatttacttaaaaactttataagatatttgaaagcttttgttagatgtctctaatgactcatcaggattttcaagtttatgccattattgtaaaccacagttacaatgctaaataaaatgaataaatttgacatctttgtccctcatcctctcgtaattacatctttgcttccactggaatgtgggtgcaagccattggtttgtttgctcaagcgacatgcactcctgagtttggacttccaagaccgttcaattagaaattactcgtgctacacatttggtgaggatgccgtaaacaacgagtaaagtagaaaaggaaaaaagaaaaggaaaaaagcatttgattgactgtgttttcaagtaaaatatagacattcatgtgactcattttatcattccggaaagtttgtcttttttagagataagtgagttatcaagaataggagtcatttgacttaatccgtcaactgaaaaatcctttgactatttcttgtccttggaaaattctttttgcaagaatcaactgcttctttcattcttccttgctacaaggttgtggaaacaaaacaatgatggttacctcaaagccctacactggggcaatgatggttacgaagtccgcatttcaagacaaaggttgcatgcatctgcatccctaaaaatcatgttaactacatagatttccaacatctaatgtcccaacttttaatttgggatgaaaggctctctcgatgagtcaatcttttgctttctcataggggtggacccttcggtactagaacctattgcctttagcggactacacgtcctcgccttcagagggctacacgccctcactttcagagggctacacgccctcgccttcagaggactacaagtcctcgccttcagaggactacacgtccttgccttcagaggactacacatcctcgtcttgagagggttgcacgccctcgccatgagaggactgcaagtcctcaccttcagagggttgcacgtcctcgccttcagaggactacatgtccttacctttaaagggctacatgccctcgccttgagagggctacatgcccttgccttgagaggactacacgtcctcaccttgagagggctacccgtcctcgccttcagaggactgcacgccctcgccttcagaggactgcacgtcctcgccttcagaggactgcacgtcctcgccttcagaggactgcacgtcctcgccttcagaggactgcacgccctcgccttcagaggactgcacgccctcgccttcagaggactgcacgtcctcgccttcagaggactacacatcctcgccttgagagggctgcaagtcctctccttcatagggcttcacgccttcgccttcagaggactgcatgtcctcgccttcagagggctgcacaccctcgccttcagaggactacacgtcctcgcctttagagggctgcacgccctcgccttcagaggactacacatcctcgccttgagagggttgcatgccctcgccatgagaggactgcaagtcctccacctttagagggttgcacgccctcgccttcagaggactacatgtccttacctttagagggctacatgccctcgccttgagagggctacatgtcctcgccttgagaggactacacgtcctcgccttgagagggctgcacgccctcgcctttagagggctgcaagtcctcgccttcagagggcttcacgcccctcgccttcagaggactacacgtcctcgccttcagagggctgcacgccctcgccttcagagaactacacgtcctcgcctttagagggctgaacgccctcgccttcagaggactacacatcctcaccttcagagggttgcacgccctcgccttcaaaggactacgtgtccatacctttagaaggctacatgccctcgccttgagaggactacatgtcctcgccttcagaggatagcacgtcctcgccttcagaggactgcacgtcctcgtctttagagtgctacacgccctcgcctttagaggactacgcgtcctcgccttgagaaggctgcacgccctcgccttgagagggctacaagtcctcgcctttagagggcttcacgccctcgccttcagaggactacacgtcctcgccttcagaggactgcacgccctcgccttcagaggactgcacgtcctcgccttcagaggactgcacgccctcgccttcagaggactacacgccctcgccttcagagggctgcacgcccttgccttcaaagggactacatgtccttacctttcagaggactacatgtcctcgccttcacaggactacacgtcctcgccttcacaggactacatgtccttgccttcagaggactgcacgtcctcgtctttagagggctacacgccctcgccttcagaggactacacgccctcgtcttcagagggctacatgccttcacctagagaggactacacatcctcgccttcagagtactacacatcctcgccttcaaagggctgcacgccctcgcctttagagggcgatgtgtcctcactttcagtgggctccacatccgcacctttagagaatttaaggtcctctgcccttaatgcttaaccgagacttgcgctcccggttaaggggccagtagtttccttttatcagctcctgggccaccccttgatcctggaggagggccaactatgcgagcacaaccagaggaggaggctatcgcgcagctactgtgcataccggggcaagatttctcccgtgccactgcaaagagacgagtgcagatcatgcgcaccaacatgaccactcttacacagatatgaatgacgttgctacttagcaacattctgcccagtgaccacaatgtcgaactccccctatggaagtatcagttgggatcgcacccacaagacacccagtggacccgaaggagtccaacagggccctggggttttcagctctggttacgggcctctgccagtcctacagggtacccgtcccccccagcaagctcatgccatcgtaacataggtaagtatgcacgtggttcaactgatttctgatgccatcccctatttgcagggatcgtgcccacaagacacccaatggacccgaaggagtccaacagggccctggggtttccagctttggttacgggcctctgtcagtcctacagggtgtccgtcccccccagtaaggtcaccccatcgtgacataggtaactatgcacatctctcaattgatttctgatgtcatccaatatttgcagggatcgcgcctgcaagacaccagtggacccggagaagtccaacagggtcctgaggtttccagctctgattatgggcctttgtcaattctacggagtgcccgtcgcccccaacaaggtcatcaggccccatattaaccaagctttcatcaagaagtattgcgcccccaggcaggcgcagggcgagacaccacagcagcctagggatggacggcagcgggcaatagatacaccgccaccacctccagagcccctcaactcatctacaaaggctggagcgttgcctacgacccatgaccgaccagcaggcgaccaattccaaagccaaaggtaagcaaaagtactaggtctgtgatcgacaagtcatcacacgtccagctcaagacgttaaagaagcgctactaggaggcaacctagtactttttaaatctctgcttgttatttgatcacctttgtttctcaagtcatagtaggacacacctagttgctcatgatcctaggaatttaaataaaacaagcacaagctcggaaggtagtcatacctcacaaaatatatgtatgtgtgtttaggtagcgaaaataccttagatatacatgtatgtaatttaggtagcaaaaaaatacctcacaatatatatatatatctatgtttaggtagcaagataccttggatatgcatgtatatagcaaaaatacctcacaaaatatatatatatgtatgtttaggtagcaagataccttggatacatatgtatatagcaaaaatacctcacaaaaatatacatatgtttaggtagcaaaatacctcatgaaaaaacaaacaaaaacaaaaaaacaaaataataataataattggttaactaaaaagccaacatgcttttgaaaagaaatagtctccagcttttctttggaaagagtcaccaatcaaaacacaagggtttttgaggaaaatgtgtctacacctgaagggtgaatgctgtgaaatttttctgaacgcccaaaatggactcgaatggatgcatgaattgataaaaaaaacatgttttggaaacactaggttgacttaaatagggaaaatgaatcctgggccctagtgtcacatgaccataaaaacttgatacttgagtgtccacatgggtgcatatatgaccagttttgcataaaatttctaaatcatcattgttgcatgtgtgtcatggaaataatgtgagacattcctttatccctgaaccgctggccaaaccaacaccctgacatacatcatgtccggccgttctacaagccttttgacccaagacctcaaaccaccataaaccttgacccaggatgagaatttccatccctgtcctcagaagaaggagcaatagggtctcccaagaaaaaaagtcattcactattgagttgctaacatgcttccataacaaagaaagttcccgatcaaagatcgaaagaaaacaaaagaaaaaaagaaattcctgatcaaagattgtgagaaaacaaagagaaaaaaaaaggagaaaatctccgatcaaagacaatgaaagaattatacagaagtgtcttcggacaagacaaatatccaaacaatacggaatagtcacagccaaataaggaaagaaaggaaaccacgacttgaagtggtcctctccgtttgattgccaaccaaaatcctgtgcgtcggtgactttttcgccccgcactaaacaaaaacagaaaaggaaaaggccaaaacactcagagccaaatttcccacaaaaaaaaaaacaccattcccgaaaaagtcctattgatctgtgatcacacatgtaatctttgatttgataggaaatgatttgcaaaatcaagtcatgacatatctatggttctgaattaggatgaaacacttacctgtgtgagattgatacactttgagtgattttcttctatttttgttggacccagtgtttcctctaaatggtcgtttagaaacaaaatgctaacatccaaaatctcatttatggttatgagaaaatttcattagcatactctccttccccattagacacattgtttttcatcaaaaatcatatgttgctctgatcagttggaggttttgtttctttactaaagcctgtttgcattttagtgaaaaaacaccgagactattttagtatcacaaaagcaagaactatgttggtctgaattcctcatcgtgattgaggatacgtaggagcaaaagcctcgcttttgtcgaccgcccaaccttttgctatcgtgacctgtgagtccgttggtgcgcggagatgccctatacggtaacccgcacacattcatttgctatccgtcagactcagagtccggtagcatgcagagactaacatcttcttctgcaccttttgtcaaccaggggcaaccgagcccgttgacacgtagagactaacgtcgtcttctgcaccttttgtcatcgagagacggcgagtctggtgacatgcgaagatacccaagcggttattcgtacaaacgatttctgttaaccctgacccgggaagtcaggtggcaggcgggggtactgtatggttatccgcacctttcgtcaaccaggggcgaatgagtctgttgacgcgcagagactaacgtcatcttctgcaccttttgtcatccagagacggcgagtccggtgacatgtggagatacccaagcgattatccgtatggttatcagcacctgtcgtcaaccaggggcaaacgagcccgttgacgcgcagagactaacgtcgtcttctgcaccttttgtcaaccagagatagcgagtccaatgacatgcgagggtatcgtatggttatccgcaccttttttcatccagagacggctagtctgatgacatgcgggggtaccgtatggttatccgcaccttttgtcatccacagacggcaagtccgatgacacgcaggggtaccgtatggttatctacacctttcgtcaaccaggggcaaacgagcccattgacgcgcagagactaacgtcgtcttttgcacctttcgtcagccaggggggaggcgagccccgttgatgcgcagagactaacgtcgtcttctgcaccttttatcatccagagatggtgagtccgatgacatgcgggggtaccgtatggttatccgcaccttttgtcatccagagacagcgagtccgataacatgcgggggtactgtatggttatccacaccttttgtcatccattgatggcgagtccgatgacatgcggaggtaccgtatggttatccgcaccttttgtcaaccaggggcaaacgagtccgttgacgcacagagactaacgttgtgttccgtacctttcgtcaaccaggggcaagcgagcccgttgacacgcagagactaacgtcgtcttctgtaccttttgtcaaccagaggcaagcgagcccgttgacacgcatagactaacatcgtcttctgcactttttgtcatccagagacagcgagtccgatgacatgcgggggtaccttatggttatccgcacctttcgtccaccaaggcgaacgagttcgatggtatcgggatgatgttggttgtccgattctgattattttttgaaatttttgcaggtttttacttttgtcatccaaagacggcgaatccgatgacatgcgggggtaccttatggttatccgcacctttcgtcaaccaaggtgaacgagttcgatggtatcgggatgatgtggtcgtccggttctgattatttttgaaaatttttgcaggttttactttcgtcatccagagacattcaagtccgacgacgcgcaagattcttcactgctaggcagggacgatcgagttcgatagcatgtggaaacgtcatggttatcctgttttatcgctttcaagacactgaagttttgctaacgcttctggtgccttttcttttctttctaaatgacaggttccgctggttgggatattgatcggccgaatgatgttctgctcgaacgaaattagtgtcttatctttacttcgcttttatctccaataaaagataagtaaagaggggcaactgtcataccctaatttcgtccagggaccattatttgttggcatgcgaccttctcttgaccgcctcaaaatgtttaacacccatcgttgtgtaatccgtaaagtctcgcaacattttggaagtcaaaacaagtattgttgcacaatccgtaaagttttgcaacattctggaagtcaaaacaagtattgctgtgcaatccgtaaagttccgcaacattccggaaggaaaaaaacaagcatcattgcgtaatccgtaaggtttcgcaacattccaaaatgaaaatgggtgttgttacgtaatccgtaaagttccgtaacgtttcggaaaggaatcaataaaaaaacacaaaagggagtgtgtttagtgaaaaagggggtgcaaatagcaaccatgcccacttgggccttcctgagagttccaaaagaaggtggtgccttctagtggaaacaacccctgctcgcctgggtgagctgggcggcaaccacctcccttttttctcctataaattggggaaagagggcaaaacaaaaggttcagcccttctagtatttgagaattctctcgaaattagtgagaaaaattgttccatgaaaaaaatccaagccgaggtgcttccgtaacacttccgagacgtttccgtaggcgatttcgtggagattcttcaccgttcttcatcgttcttcgttcgttcttcatcgttcttcggtcttcattcgataagttcccgaaattgaatctctcaattcattctatgcacccttagtggtccctacttgtttcgcgtacttttattttcatttcgtttgttttccgtacccccttttatcgtgctttaaccgtttatttaatccgttttctcacatagtaaatgataaaataaatttcaaccgatcatttgagttgtaatctcgattaatcaccattaaagtaaaatctaatcaatcgttcacactgtaaccacggttagacaaaaaaagggaaaaataataataaaataatcaaaatatctttgaataaaataatcaaaaaaatcaatcggatgtttttctttggaagtttccttgaatgaattgactaataatcaaagtgaaattaaggctaaaatcaactcacaaatcaagcttcgtccgcaaaagtcactcaaaaccgttttaaggtccaacgccttaaacgatcatctttgcttttatcggttaacatggaccgttctaaagcataaaatcaacacataactttaccgcttttgcaagaactacgtaggtctgatttcctcatcgcaattgaggatacgtaggagcaaaagccccgcttttgttgaccaccccaagagatcgttaatggtccaacgtcttaacgtttctctcctttcaaaaccaagagatcgttaatggttcaacgccttaacgtttctctcctttcaaaaaccaagagatcgttaatggtccaatgccttaacgtttctctcctttcaaaatcaaaagatcgtttaatggtccaacgccttaaatgaccttttgttcggttaaaatatatcttgcgaaaaaagataaaaacaacttaaccaacgtttagttctaaagaactacgtaggtctgatttcctcatcgcaattgaggatacgtaggagcgagggaaacacccttgtcgaccacaaaaagataaaaaaaatacaaaaagcataaaaaagacataaaaacataaaaagggaaaataaaacaaatcgaagacatgatattgcacacttggttaaaggttgtcgtcccttgtgacggacgcgtggggtgctaataccttccccgtgcataaaaacaactctcgaacctttcacgattaaagttcgtagaccacacctttttcggtttttccgatgttttcctcaaataaatgttggtggcaactccgtgcattttcctttcttgaaaaacgcacctgtgagccccgcgtcgccctcccgccgaagggtaggttgcgacactacccatgtgcaaatgaaacatgttttcattgtgtaattttttatgctttctaacaaaacaaaaacacatttttgttgtatgtctagaccaaagaaaacacatttccattgtgtaactatccatgtgcaacgaaaacatgtttttgttatgcaattagggggaaaaatacacaaagaaagtgtacttttgttgtacatttttttcaccccaattgcacaatggaagcacgtttctattatgtaatttttaaggggacagttttgaaatatggacaaaaagcacccctcacggttagtgccattagaaaaagtaggtggtgcctatagtagttcgctaatattggatatgcacttcttttatcagaagggcccaaatagtccatcaaatagtagaagtttttgccaatgtcggaacgtgaacaaacatactaacaaacatgtgcttgattaaaaataaaaaataaaagaaaaaagattttggatgagtatgaataatgaatcaagtggtggggtgtggccaccactaattgcattttggcaaaacagaattcacatcttgacagcaaagttgattgattcactgtccatggatcattcgaagcaagtggttgtttgcggcgatggagtcatcgaagtctgcaccgcctactttctggcggtgaagggtgtctatatcatgctcattgagaaattcaacgtggcatgcactgcattcgaaaaagctggcagattccttgccctcaattggtgcaatagaggaccgctagaagagctagctcacatgagcttcaacctccaccgttcactcttcgaagaactagacggttcatgatcgtacagttacagaaccctcaccactctcagcctcatcgttacggaatttgaaggctccttttctgccacctcaatgttgtcgtcttgagttgacagacctactcgtggttggaaccatcgaaatgacagtgcaggtgcacctatggctcttcattcccgcgctgattgatagatcagtggagaagcatggagtgaagatagagattacaaaataggaacggttggaagtggaagaaggatgagttggatcgatggtgcttgaagaaggacgagttttggaagcggattctatggtgttaacattgggcccttagtccagtaagttggttttgttgttcatagtttatgggcttatgggcttaaggcccatagcattgtattagaggccagagagcccggttctataaccctgcatgccctctttctcagttactattcttctaaacgaggaaaatctcttgaccccgaagtgtaccctccccacacaggtatgttaattttatttttttacagaacatctaccgactttaccaatcattaatttttattagagaatttaactggtcacttttaatgagttcttcccttccaaacagaatctagtatcattcggacaaacgcaacttgttgattcccaggtgtagtaattagtcacacttagtaataataatattaataaagaggttaataatgtaaacatttattttcaggggaggtttatatatgtgggatgtcgaaggagaaagaagtttcggataatcgtgaggagataaagggaaaccctgaattaattgtgatgcttaaaaaggtggtgaagactgtttcaagccatcttagggaaggagtggcatgtgtgaagggagagtaataggagaggttccaggggtgaaggggtgttatgttgcaacagggcataattgggataatattcttaatggtcctgccactggagttgttgctgagcttgttattgatggacattccaacattgttaatcttaagcgctttagtcccaccagattcctggggcgtagaaaggcttagacaataaagactacgagtgttagtttaataactttgtgtcataccctaatttcgttctaagactatcatttgttgatcttttgatcctcgctagccgaattaagctgtatgacaccagttaccgtgcaagatgaaagatcatttgatgtttccataaggaatacagaaaatccccaaaaaagagggcaacagggtcattttaagcctttttctgaacccaggctagcccctggctcgcttaggccccaaaatagcttaggggtgaaataactagctcgcctgggcaagcaaagttacttcaggttgaagctataactcgcctgggtgagctgccatgactcctaatgccatcttttgctataaataggtgtgagggaggctgagtaaagggttccaaggtccaacattgagagaaatcagagagaagaagaagaaagaagagaaaaacgaggccgaggtgctaccgaattgcggatcctaatcgacttctacattgttcttcgtttgttattcgtttgtcatccggttagtttttgttttaaggatttgaatgcgatctacgcacccttacgagtcctctttcttgttttgtgcatcttcatctccttcttttatcatcaataatctcatcttcatcctctttcttgttttgtgcacccttacaagttatctttaaaaaagattgaaggttaataagcaaaaccaaaataaaaccaactcataaacttcttcatttaatcaaatatcgcttgagatcgtttcaaggtccaatgccttaacgattctctctgcttttcatcaaacatcacttgaggtcgtttcaaggtccaacgccttaaccattctctccgcttttcaaatttttaaaacatcgtttcaaggtccaatgccttaaacgacttttgttcgcaattaaaatcgatcttttaaaaagcataaaattaatgtaacacacaaactttcagacttaaagaactatgtaggtttaaattcctcatcgcacctgaggatacgtagaagcaagggcaacacccttgtcgaccccaaaaaataaaaaatataaaaagggaaaatacataattttgaagtcacatttttgcacattcgattaaaggctgccgtcccttgtgacggatgcgtggggtgctaataccttcctcgtgcgtaaacaactcccgaacccatattttcaaaatccgtatacctctttttggttttttctaacgttttcctcgaataaatgttggtggcgacttcacgtgttttcttcatgagaagacgcacctttggcttttcgcctcgccctttcgccaaagggttggttgtgacagttggcaattccactggggactgttagagagttaggtcattcagccagtgtgcaatgtttttatcgtgacttcttctttatttatgttcccttttcccttttatcttttgttttgtccatatttgtatataatctttgctatgttgttgtgtttggtgtgtgtttgtctatcaattacattcatagttagaaatatttttttctacgcacacatggcacctacgcctcgcacacacgttgagatattaggccctatacccgggtctatgtgagccataaggagtggaggtcaatctgtgttcatgctgggtctctgactcgcttggtaacagtgaagccttatctagagttttcctcttttggtgatgcattgtcgctgatagtccctatcgccacaatgtattatctaacaggatgatatctctagagaccggtaaagttacatgaaaccatccttggaagttgtgactagaaggggaccttttggatcctttccattaggttcctaaattagggtggcacatagaaaactcactctggcttgttctttgatcgcatcatgcatctcttcatggcatcataatgtacatatcattcttgcatttatcatttgtcatatccatgcattgcatttgcataagttgttgcattgtcatgcattttcatttagcatgcttttgttctgccaactgcatacattctattttcatagtttgcatgcatgatccttgcattttcctctgcaaaaaaaaaaaaattaaaaataaagaaagaaagaacaaaagaaagtcaccataaagtgtgaaagtttacaccacattcttagttacatgtgttgggtactatgatgatagctataaaccaaccatgttgggattatgcactcatttctcttaaaaaattattgaaaatcatgtgaacatggtacctaatgcatggttaacttggaaatgatgtttcttcaagcatctcatgtcaacctcataattacatgtgtcatgcatagcataagtatgcccaagtcattcatctctatgatatgttgttgaagtattgacagtcaaaatttctattccttggattatggggtcgaaccaagcacatgcttttaagaaaaaggtttcatcaagtcaaagtcaagtatggaaataactagctgcaaaagttggggcagaagatggatcaagtttacatagcttctttgtctactgccaacacatggttgagctaaataattaacaaaaattagggattgttgatgtccatgcgttatttcctattgcattttgacaaaatgtaatgaacaatgttgttttaatgaaaatctaaattggttcgaccctattgagtgccctatgtaaatttgcaatacttcaacaatgtatttgttcacatacatccatgcttattttttcttttcacgttggttgcattgctcatttcattatttccttgaaatcagaaactgtaatcattgtaatcaaaaggaaagaatgcacttttatggcgcccttaccgaacgcgtgcatgagctagaataatgagtgaaatagaagaagtgcaagaacagatgaaggccgacatggaggccatgaaagaccaaatggccgccatgatggaggccatgttgagcatgaagaaaataatggaaagcaatgcggttgcagttgccactacgagtgtcaccactgaggtagacctgacttacttatcgagcctcaatcaagtaaatcctccagtcaccattttgtgcaagtttagagcaagcattcattccctggcttgcctcccaactacgcaccacccaatgttgcacacactcacgatgagaatgtcgacaacttcatgcccccatacccattagagccaaaaaccccaatctgatcatgcacatgtctctcaacccatggaggagacacatgaagcaccccgagaccataatataatcgacttcgaacctcacctccgatatgccactgaagggcaagcagttagtggtgtacccctgccaaacactttgggggcccttagtttttcccacaaccacaacccttgcattttgcggtgggaagagtccctcctgctatggtggaaagggaaaaattcaatcagagagaggaaagactgagggctattgaaggaggcggagatcatgcttttgctaacatgggcagagttgtacctagtgcctaacgtcgtcatccctccgaagttcaaggtgtcagatttcgataagtacaaggggactacttgccccaagaatcacttgaagatatattgcaggaaaatggggggcatacgcgaaagatgaaaaattattgatgcatttctttcaggaaagtcttactgagatagtcgtcacctagtataccaatttggaaccttcccgagtccattcttggaaggacctaatggttgccttcattaggcagtatcaatacaattctgatatggctccggatagaatgcagctacagaacatgtgcaagaaggagcatgaatctttcaaagaatacgcccaaaggtggagggatatggcaactcaagtagcgcccccaatgatggagaggaagatgataacaatgatagtagacatgttaccgatgttctactatgagaagatggtgggttacatgccttcaagctttgttgatttggttttcgccagcgaaaggatcaaagtggatctaagaagaggaaaatttaattatcctacttggatgaatatgaagcttggggaaaatggagagaataagaaggagggaagaacccgtgctatgactgttgtccctacatggccaaatttctcgccaacttaacaatgtcaacactcagccaatatcagtccttctcattgcccaccaccctaccagtcaagaacacccaatcatccacaaaggccacccctaaatcagccgcaaagccctcctgtcgcacatccgatatcaaacaccacccttaacacaaaccaaaacactaaccaaggaaggaattttctagaaaagaagcctgtagaattcaccccaattcccgtgtcgtatgctaatttgctcccatatctacttaataatgcaatggtagtcataatcccaacaaagattcctcaacctccattttcccgaggatacaacttgaatgcaaaatgtgcttatcatggaggagttcctgggaattccattgagcattgtatgaccctgaaacgtaaggtgcaaagtctaattgaaattcgaggaggacaatcgcttacgaattctaacgttgtcaagctacactatgcatggggcaatttgaaggttgttgttagatgtctccaatgactcattaggatttttaagtttatggcattattataaacaatagtcacaatgctaataatatggataaatttgatgtccttgtctctcattctctcgcaattacgtctttgcttattttactttcactggaatgtgaatgtaagccattggtttgttggctcaagcaacctgcacttctgagttgatctccaagtctgttcaatcagaaattgctcgttctacacgtttggtgagggtgccgtaaacgacgagtaaagtaaaaaaaaaacgtttgattaatcgtgtttcaaataaaaaataagaagtaaaaacattcatgtgaccttattttatcattcttaaaagttttctttttgagagaaaagtgaattatcaagaacaagagtcgttcgacttaatctgtcaattgaaaatcctttaaacatttctcatccttcggaattcatttttgagaacctgcatagtttctttctttttttccttgctacaaggtcatgacaaaaggcaacaatagatacctcagagccctacattggggcaatgagaggcaccatgcatgagcctcaagcaaacttaggggcagatcagaagttcttacccgataggttcagaacctgaaagggtgacctaggcaaaagttagggtaataataaaaaagaaaaaaaacaaacaattaggggcgtgttattaaggttttgtctcaaaatccaaactacaaaagtatctagtcaagatttgaaatgacacatggccatgtttcaacatcccaaacactaatttatcccttgctaccctctccgaaccaaagcatatttgttttcgaaaaacaacaaaaacaaaataggaactctgagtaggaaccactgctaaactggtgggaagagcaatgcaaacaacacatgcatgaagttgggaaacaataataaaaaaagagagataaagtccgccaaaggcgagtgaagaaaaaaaaagagacaaaagatctccaaatcttacaagaaaggcacaaaagtgcaataaagattactgtataagacaaaaggagtagagctcaacccaaaaggtataagcaatgctcttgaggttcttactcaatgtaacccttaaacactctttaagcctctctaaatcctttctttcatagtcttcttacccctgaccacgttacaagcccagtaaagcccatgtggatcaaggaatgactaatttttcttttaagttgggattctagaatgaaacctacacacgcttgtgattgttaaaaaaatatatatataaacaaaacaaaaagaatcctcgaggttttgtacttgcacatttgagaagaaaactcattcgaccaggagctcatggaaaattcccaaagacaattgtgatagtagggtacatctgagaagaaaactcattcgaccaggagctcatggaaaattcccaaagacaattgtgatagtagggtacatctgatattagttgctcatgcagactccttagaattccttttgaatccagggtggcctttgtggtataaattctttcgggattagcccatttcatcaagtttcagtggaatcgacaaacccttggcatcactctatgaccttaaatcaggaaagtttcacttggtcacataccaaagtgtgacaattcattgccatccttcagtgtggtgcacaatcgatcccaaagccttatgttttcttgctgtgcagaacaatagaaggttttaaacaaaaaagaaagggacaaaccctaggatcaatgtttcggttgattgattaaatgtaaaacagctccattgccgtcactccaaaattttcaagtgatcaaacaaaaacatacactctaagggagtcatcgaagagatttgcaaaaaaaaaaaaaataaggttgcatgaattatcatgtcttctagaaagagacagtcaatatgtgttttccacaaaaaaaaaaatcaaatcaaaatcaaaatcacaaaaataggaaagaatgtcatgagcattacacaattttcatgattcaaaaccttttgcattattagcatttcaagatgaaggttgcatgcatctgcatcccaaaatcatgttcatattaggctataagtgcgtagatttctctttatataccactttaccaaatctaattttttaagttaaggatgagaggccctctcaaaaagtcgatctcttgctttctcttaaggttgagcccattggtactagtgcttattggcttgttttagaggattcaaagtcctcacctttatcttttagaggacttaagatcctcgcctttatcttttagaggactcaaagtccttgcctttatttttcccaggattgaaattcctcgcttttatctttcacaagactcaaagtcctcacttttatctttcataggactcaaagtcctcacataattttgaagtcacatttttgcacattcgattaaaggctgtcgtctcttgtgacgggcgtgtggggtgctaataccttccccgtgtgtaaacaactcccgaacccttattttcaaaatccgcagacctctttttggttttttctaatgttttccttgaataaacgttggtggcgactctacgcgctttcttcatgagaagacgcaactttggcttttcgcctcgccgtcccgtcgaagggtaggttgcgacactttgatataggttatgacgccttctagtgtggtaaagtccgatagggtcctgcaacatgtgtaactattttttggcctttggatatatctattactcaatgtgtttgcaagtttctcttatctcaaccgtccaagatcgcttccttttttttaaaaatagattattttatttttaatctaacaatcaagatttttttgttatttgttttttctttttagcctttctatctttatctctttccggtgagaaatataatgaagatgtatttacatatccaaagacaacaaatacaacaacaaaaatcatataataaaataatacgatacaattaaacaattttcaattgaatcaagtaatagaacagatctaaagaatttcgtgaaaaatcttaatctttaaaatcaaccatcaacaattgttaacatatttgaaaattttcatgaaaaaacaaatttcttatctcccagatgagtttaacgagatccttgtgcatagattgttgtacaccaacacttttgacaaagcttttttttcaagcctaaaccaccatctgtggaagcaaagcttcatgatgaatcaacaatgattcaaaggtgttttgatgataacaatgatgacaacaaaagatgatgacaatggtgatgaacaaaaagttcaaaagatcaaagaaaaactcaagtgaatcaaagaacatctcaagtgaatcaagaacaagtcaagagttcaagaatcaagaagaattcaagactcaagaagaaagcctacaatcaagaatcaagattcaagatctcaagaatcaagatcaagattcaagactcaagattcaagactcaagattcaagaataaagaaaggactcaatcaagataagtattaaaaagtttttcaaaactttgaacaacacatgagtttttgacaaaacctttaccaaagagtttttactctctggtaatcgattaccatattgttgtaatcgattaccagtagcaaaatgagtttgaaaaagttttcaaactgaatttacaacgttccaaatattttcaaaaggctgtaatcgattacaatgttttggtaatcgattaccagtgtccttgaacgttgaaattcaaatttaaaagtgaagagtcacattgtttcactcaaaagctttgtgtaatcgattacacatatttggtaatcgattaccagtgtttgttttttaaaaatctaaagatgtaactcttcaaaaaggttttgactttttcaaatgggttttaagtttttctaaaaagttataactcttctgaatggccttcttgaccagacatcaagagtttataaaagcaagactttgttttgcattccgaatcaatctttccaacaacaatcttgaacaattattcatacaatcctttacaagccttgaatctctttgaatctctttgaacttcttcttcttctttgtaccaaaagctttctgaagttttctggttttctaaaccttgaaaacttgtgctattcatccttttcattctcttctccctttgccatttgccaaggactaaccgcctgaattctttttgtgtctctcttctcccttttccaaaagaacaaaggactaaccgcttgaattcttttgtgtctcccttctcccttgtcaaagaattcaaaacgacacagtctgagaattcttttgattcttcccattccctaatacaaaagcgttcaaaggtttaaccgcctgagaattcttttgtatccccattcacaaagtattaaaggtttaaaagcctgagatctttgtcttaacacattggagggtacatcctttgtggtacaagtagagggtacatctacttgggtttgactgagaacaagatagggtacatctcttgtggatcagttctagtggagggtacatccactaaggtttcaaagagaacaagggagggtacatcccttgtggatctttgcttgtaaaaggatttttacaaggttgaaagaaatctcaaggaccgcaggtcgcttggggactggaggtaggcacgggttgttgccgaaccagtataaaaactcttgtgtgtttgtttccttcttccatactcttttactttccactgtgcatttaattttcgcttttactttctgttaagtttctcttctactccatattctcttaacaacaaaagtaaaagccttaaaagagtaatttttaattggtaaagtttttggaataattaattcaacccccccccccttcttaattattctgaggccactcgatccaacaagtggtatcagagcaggtttcttgtaggatggcctcctcaaatcccttgtttcctgaaggaaattctattcacagaccacccattttcaatggtgagggttaccattattggaaaacccgcatgcaaatattcattgaagccatagatctaaatatatgggaagcaatagaattaggaccacatatacccactatactatatgtaaccctcagttctttaaccccaaaaccctagaatcacttggacagatgaagatccgagaaaaatccagtacgatctcaaagccaaaaatatcatcacttcagccctagggatagatgagtactttagagtgtcaaattgtactaatgccaaggatatgtgggatactctccagttaacccatgaagggaaccacagatgtaaaaagttctagaataaatactcttacccatgaatatgagttatttaggatgaatccaaatgaaaacattcagaatttacaaaaaaggtttacacatattgtaaatcatcttgcatcattaggaaaagtttttcctaatgaggatttaattaataaagtcttaagatgtttaagtagggaatggcagcccaaggtaactgctatttctgaaagcaaagatctctcttccatgtctcttgccactttatttggtaaattgcaggaacacgagatggaacttcaacgcctcaatcagaatgaagaaaatgacaaaaagaagagaagcatagcccttaaagcctcatcttcaatacaagaagaaaacgaagaagaagattctgatgatgaagatttttccttctttgttaagaaatttcagaaatacatcaagaaaagaagaattgataggcgtcagaatttcaataatggaagaaaatcacaagaggattctcaagtccttaggtgttacaaatgcaaccaaattggtcacatcaaggccaactgtccgtcaaatgaagaatggtcggagaaaagtgaaaagaaaagatttgacgaaagaagaactaagaaagcatacattgcatgggatgacaatgattcatctgatggttcagaaaaggagattaatcttctaactaaagattatgaaagtgacaagaacttctctcaaggataaaaagcatgatcctcatctttgaagatctagactcttcaattctgaaaaaggtaatatcaaaaccattatcttattaaaatttctcttaaagttgaaatttttattcaaacaaattgactatgatgactaaaaattctttatttgtttgtcttttgattgattgaaatcatgagtatatttgcttgattgatttcattctatttgcatgaaatattcattcatttatttaagtaaaatcaatattcttcatacttgtgttgtaattgttcttgataaaattgattatcttcatgttttaaatatttttgcatgacgtgatatgtaaattacatgagtgaaaattagtcataaagtattttcaaatatagtattttcaaaaatagttttcaaaacttcttctctcctagaaagccttctatttttgttttctggctaaaataaccactggtaatcgattaccataatagtgtaatcgattacaagcagttatttctggcaaagttgctctctggtaatcgattaccatattgtgtgtaatcgattacgatgcgtccctgcacctatttattcaaatttcaaattctgaaacctgcaacttttcattctctcgaaaaccctcgcccccaatttttcttccagccatatctcactcaattcttatccaaatcactccccacaaagcccaaacttcatcttttttcaatctctttcatttgaaccgattgaaatcccaaaaaaactcttcaaatggcagaaccatcgaaaaagagaaaaggaacttcgagtcggagtcagctgcattccgggtcacaagaagcaccaattcctccctccattccctctggatcattattctcatcagaggaacagcgtatacggtacacaaacctcttttcctctcgttccattgtagacccaaaattcatagatatggagttcttctcaaatgagaattttgaatgcttccaagcatttgaaaactccaatcttattccattcatgtctctgaaattacctgtctattctgaattagtcaaagctgaaattctgatactgaggacagatgtcgtacaggatgtcacgacatcgcgcttcagaacatgcagattgtatatgacagtatgaacagattaaacaagtaaataacacaagagaattgttaacccagttcggtgcaacgtcacctacatctgggggctaccaagccagggaggaaatccactaaaatagtattagttcgaagatctaacagccactgtatacaaccttctcacctaaccactacccatgcaacttctacctaagagccactcttagatatgagaacccctctcactccctctcaatcactcacccgtgtttacaaacaaatcaaagacacaccagagattgctctctgaacaatagagatcaactctacacactcaggtccaacacttgatgttagggtaacatcaaggtggctcacaaaacactcaagtcacaaaactcacaaaataactcttcaatctctgacttgataaaaaacccgtgcagccttcatgtttatatagcagtgtacgtatctgggctgcaacaacttccgctggataagctctatcattctcctgaaaaatctgcacttaaagatctaaaagataaagttttatcttttagtttttatcttcaatctctaatccctgaacgaaactattcaagtttgtaattcaatctttaattatcttttaattcgttcctaaagatagagctcctaatctgttgctgactgcacattaatctgttaaagatataacagatttatgtgtccagtattttcgggcaggatgtcctggacattgtatccgacatcgtggatcctgcagcttcaattcttcatttgacattttatcttgccttgtgcattgtgcaccccaatctgattccttgacataatgttagacatcatgtgcagcaactccagctttccttcattgtctaagtgctttatgttttaacaaaattttagccaatcttttaaaactaagtaaagctaagcactaacaatctccccctttggcaaattttgtctaaaacatacttagacacttcctgagcaggtacgagcagtcatgcaagtgggatcagcaactttcattatcagagtaatcaagcacagcagtatctgtagtggtgacagcaaaattctgcaagttgcaaatctacaagtcttttccaggatgtcaagacatctcacgtgacatcagctttctgctccccctgtctccatgctcttactgctgtgaagtgaatattctgctaggcagcagttcactgcagcatcttctatcagctactagtttcagtagcttacatcaatcatcatcagcagcagcagtataaatactactccccctcaaaatcataaatcatgcataatatccttcataaatcatgcataatatcctactactccccctttttagacagaatttggcaaaagtagaaggcatgaaattaatgtgcaaatattacagaccaataacaatcaattgttcaaagggacatgccccaatagctagtcatggggtggcatcagaatcatcatcatctgattctgtatcctctgctgcatcttcttcttcctcagctgcttctccatcatcaacgccattgtctgagagtcttttgaccaggcgttccagctccattttcttctctgtgttggctttgatggttgcctccagcaccttgcatgtgtccttgagttcagcaatcaaatcatccttggacacagcacctgaagcagcagctttccctaatgtcgagacaatgtctgggacatgtgtccccctcaaatagtttgtaatgcagggatagaggagattctctcttcttcacagagtcaatgttgtttaaaatattgggatgttgactcaacataatgccacacaatacagttgggaaggcaatgggtaatttgacagcaaaagattctgaatgcttaatagtttgatcaaaaatatagtttccaaaattaaatttggacttggttccaacagcatacagaaatttacccaaacctgtggcaacaatggaagtatgattgggtgggtaccccagttggcagtgccaatcctatgtaggattgcatacttcacacttagcttccctgcagacagcttccctttctttggccaatgctggacttgcttggcagtgatttccttggcaatttgatgctcagaaacagcaatatccaccactccttcagttggtctgcccaggtacttgttgattacagcaggggagaatctaatacattttcctctgacaaacactttctgatactcatcactctttctgtttgttatgtcagagggaatgttgacaatgaattccctgactagactttcataacaatctcccaacttggtgacagttttcagcagtccagcagccttgatgaggtccatgatctccttgcaatccaaggcatctcttcccagttctctttctaaagcaagtctgcgttgatatacaaatttccacctttcaacattgccaatggagtggaatgaaatgttgtccaatggggcatcagggacatttccaggcacctttttccctgatttcttggctctcttgatgtcgggaacatctagttcgacatcatcatcagaatcagatgaggaaatttctttcctcttcttggaagggattgcaactttgctccatctggatgtggtaggagtgattggtgtgctcttcttctgtgcagtagttttgattcgtccagacctagtaatgggggtttttccctttctgctttgtaatctttctgcaatgccaggtgccaactttttggcaatgggttcctcatcagattctacttcttctaggtcaatgaagtcacctggagcaggttctggtgcccttggtgcaggggtctcctctgtggcttgatcctcttcctctgttgatttctctttactggatgaagagaggacttcagcatttggggtggaagatgttgggacatctttatcagcatcagggacagaagcatttttcaaaatgctattcacaaaactgcggatcttcttatccatctcagtgtcttcttccctagggcttgttgcaaagctagggttttcagaaatcttcactccctgttgtcttttagggaccagtttctcaggaacagggcctggaccaggaatcatttgtatggattggatattgagtgcaggttgttcctggtttgatggagttttggaggatgatggagatgatggtacagagggtgaaacaggggatgaggtttcttttggtgaggtagccatggagaagcagagctttgggagtggtttcgtgaatatctgagaagtgttggggaatgctgatgaaaacgagattgccacgaaaatgtaagtttgaatgaggaatgtaggagaacgtgtgaaacggaggttgaatttgttttggcccagtagtgaacgtgctattaatgttaagtgagaagtttgagcacgttcagatagaagtaactgctataactcctctagcagacaaatgcccagcttgcccctcagtttttcaaactgatttgcatccaatgcctttgtgaaaatatctgctacttgttcctcagtggcaacatgctccagtgtgataactttatcatcaacaagatctctaatatagtgatgtctaatgtcaatgtgcttggttctgctgtgttgaacaggatttttagaaatattaatagcactcatgttgtcacagtacaatgtcatgacatcttgttcgacattgtactccttcagcatctgcttcatccaaactagttgtgaacagctgcttcctgctgcaatatactctgcttctgcagtagatagggacacacagttctgcttcttgctgaaccatgaaataagattgtttcccaaatagaaacatccaccagaagtgctttttctgtcatctgcacttccagcccaatcagcatcacaatatccaaccagcattgaatctgaacaatgacagtacataattccatagtcactggtgccatttacatatttcagaattctctttacttgattcaagtgacttatcttgggattggcttgatatcttgcacaaacacctactgcaaaggtgatgtcaggtctgcttgctgttaaatatagtaagctcccaatcatgcttctgtacagactttgatcaacactggtgccagcttcatcctttgacagcttcaagtgagtaggtgcaggtgttcttttatggctggcattttccatcccaaacttcttgacaatgttctttgcatacttgctttgtgagaggaatatggagtcttccatctgcttcacttggagtcccagaaaataagtcagctctccaacaagactcatctcaaattcagattgcatctgttggacaaaatgtcgaagcatctcattcgacatccctccaaacacaatgtcatcaacatatatctgtgctatcatcaagttttcagcatcttgtttgacaaagagagtcttgtcaattcctcccttcctatacccttgctgagtaaggaactctgttagcctttcataccaagctcttggagcttgcttcaatccatagagagccttcttgagcctgtatacatgatctggatgagttggatctacaaatccctttggctgctccacatagacttcttcattcaggtatccattcagaaacgcgctcttcacatccatctggtacagcttgaatttgaggatgcaagctacaccaagtaacaatctgatggactcaagtctagcaacaggggcgaaagtttcatcaaagtctacaccttcaatctgagtgtagccttgagtaacaagtctggccttgtttctggttataacaccttcttcattggttttgttcttgaagatccacttggtgccaatcacattagttccctcgggtctaggaactagctcccaaacttcattccttttgaattgctccaattcttcttgcatagcattgatccagaactcatcagtcagtgcctctttcacattctttggctcagttttggagacaaagcatgaattggagacaatctcaatctcccttgatcttgtagtgactcctctgtttggatctcctataatcagctccttggggtgcatcttctggattctaatggagggactcttgtcaggttgattgatgtttggttcatctgtagcagaatcagagttttctgcattttctgcattttctgcacttttagctgtatctgctacattgtctcccgatgttctgacatcgtcttcgacatccttctttcttgctggagttagatcatcaacaaccacattgatggattccatcacagttctggttctggaattgaatactctatatgctctgctgtttgtagagtatcccaagaatattcctgcatcactcttgggatccatctttctcctttgctctctatctgccaaaatgtaacatggacttccaaagatgtggaagtgcttgacagttggcttcctccctttccagatttcatacagtgtggttggagtccctcttctaagtgtgactctgttgtggatatagcatgctgtgttcatggcttcagcccagagattatagggaagttctttggcatgaagcatgaccctagcagcttcttgcaaagtcctgtttttcctttcaactatgccattttgttgtggtgtgatggctgcagagaactcatgagtgatgccttcagatgtgcagaattcagtaaacttggttttttcaaactctctgccatggtcactcctaattctcttgatgacacagtctttttctctttgaagtcttagactcaactctttgaatacttcaaaggtgtctgatttctctctgataaagttgacccaggtaaatctggagaaatcatccacaacaacataggcatacctctttcctccaaggctttcaacttgcataggccccatcaagtccatgtgaagtagttccagcaccctggaagtggtctgatgttgaagcttctggtgggacatcttgacttgctttccaatctgacattcaccacagattctgccttcttctattttcagattgggaatgcctctaacagcacctttgtcaatgattttcttcatgcctcttaagtgcagatgtccaaatctttgatgccatattttgacttcatcttctttggaggatagacatgtggaggagtaactggtttcttgaggtgtccataggtaacagttgtcctttgatctgctgcccttcattagaacttcactcttctcatttgtcaccaagcattctgactttgtgaagtttacattgaatccttcatcacacaactgactgatgctgatcaagtttgcagtcagtcccttcaccagcagtactttgttcagactaggaagtccatcatggactagctttcccattccagtgatctttcctttagagccatctccaaatgtcacatagctagtggagcaaggttcaatgttcaccaggaattctttaactcctgtcatgtgtctggaacagccgctatctaggtaccaatcttccttagctgatgctctaagtgaagtatgaacaacaagactaacaatcttgtgttttggaacccacatcatcttccttccgctgctgctactttgagttccatgatgtggatggccatgtagatgatagcaaaaaggctttatgtgaccatacttgccacagtagtgacacctccacttctttcttttgctctttttctgctgcgttccatgatgtcgagaccgatgttgtgacatcgtggctccagtgctgtttttggcaggaacaaattctgtcatggttgttctgccagcagatttatgattaaatccaagtcctctctggtttccaacattcttcccaagctgtagcatctcatcaagcatatctgagcctttattcagcatctttattgattttgtcatgttttccagtttagagttcagaaaaccaatttctcctttaagctcagagatctcctcttcatgtgcctccttctcagcctccagatttgcaatgatcttcttcagttgagcttcttgctgaagaatcttctcacttttgatgcatagttctctataggatatagcaagctcatcaaaagtgatttcaatatcaatatcacttgaatcttcatcagattcaaatctcccagtgagtgcattcacatctctatcagaatcactttcttgttcactctctgtatcatctgaccaacatacagaaagtcctttcctctgcttcttgagatgggtgggacattcagctttgatgtgtccatagccttcacacccatggcattgaattcctttgctgtgactgggcttttcatctgacttcttctggtattcactacctttcctgatgtcgaaagggatgttccggacatgtggtttctgcctcctgtccattcttttcagcactttgttgaactgttttccaaggagcacaactgcgttagtcagaccttcatcagtatccaggtcatactcatcttcttctccttcatcattggacacgaacgccaggttcttgctcttcttttcagtcctatccgagagtcctagctcaaaggtttgaagggaaccaatgagttcatctactctcatgttgcaaatgtcttgggcctcctctattgcagtgactttcatgtcaaatctcttaggcaaagatctgaggatctttctcaccagcttttcatctgtcatcctttctcccaaggcagtgcaagcattggcaatttcaagaatgttcatgtggaagtcatgaatgcattcttcctccttcatcttcagattttcgaattttgtagccaatagttgcaatctggacatcttcactttggaggttccttcatgagtggttttcagaatctcccatgcatccttggcaactgtgcatgtgttgatcaatctgaagatattcttgtcaactccattgaatagggcattcaaggctttggagtttccaagtgccaattcgtcttcttcttttgtccagtcttcttctggcttcaattcatcagtgggctttccttctgtgtccagcatcttgggatgttcccagcctttgatgacagctttccaggttctgctatccagtgatttgaggaaggccaccatccttgctttccagtattcatagttggttccatccagaattggtggtctgttcactggtcctccttctttctccatgttcatcagaatttatctccctagatctcactcagtgatttagagtgcctgctctgataccaattgaaattctgatactgaggacagatgtcgtacaggatgtcacgacatcgcgcttcagaacatgcagattgtatatgacagtatgaacagattaaacaagtaaataacacaagagaattgttaacccagttcggtgcaacgtcacctacatctgggggctaccaagccagggaggaaatccactaaaatagtattagttcgaagatctaacagccactgtatacaaccttctcacctaaccactacccatgcaacttctacctaagagccactcttagatatgagaacccctctcactccctctcaatcactcacccgtgtttacaaacaaatcaaagacacaccagagattgctctctgaacaatagagatcaactctacacactcaggtccaacacttgatgttagggtaacatcaaggtggctcacaaaacactcaagtcacaaaactcacaaaataactcttcaatctctgacttgataaaaaacccgtgcagccttcatgtttatatagcagtgtacgtatctgggctgcaacaacttccgctggataagctctatcattctcctgaaaaatctgcacttaaagatctaaaagataaagttttatcttttagtttttatcttcaatctctaatccctgaacgaaactattcaagtttgtaattcaatctttaattatcttttaattcgttcctaaagatagagctcctaatctgttgctgactgcacattaatctgttaaagatataacagatttatgtgtccagtattttcgggcaggatgtcctggacattgtatccgacatcgtggatcctgcagcttcaattcttcatttgacattttatcttgccttgtgcattgtgcaccccaatctgattccttgacataatgttagacatcatgtgcagcaactccagctttccttcattgtctaagtgctttatgttttaacaaaattttagccaatcttttaaaactaagtaaagctaagcactaacaaaagccttctattctaatttagaaattcatgaaggtgttctaatgtctgaaatctatgggattaagatgggtcattgaccaatccctgttttttgacttaaccaaattgcctagtgaaggtatgacttttgagggtgcactgattgatgaatggaaattcgatttctctgtgcatgatgcccgccgattggtttgcaccaaccaagcggatatgactggaagacttcttgctggttcattggcttttgaaagccgcatcctccattaccttatagttcgcattttgcttcctagatcttcaaaccttgcccaggtttttgaagaagatctcattgtcatgtgggcctttcataaaggtttacaaattgattgggcacatcttgttagatatcgcatgcataaggcgttgcgattgaatgccccgttgccttatcctcaccttgttaccctcttccttcaacatttcaacatccctcttgattctgaaccttatgttccaatcaagagatcattccttataggcgcttcagtcatagcatcctttggttatattaaggagcatgatggatcatgggtaaagaagggtgctagaaatattggtgaagaaggtcatgagggagaagattcatctcttctttcgaagattttggaaaggtttgatggtcttcaaacctttgttggtgagaggtttgatactttggaactgcaagtggatatgcgcttcaatgaaatggagtcaagaatgactaaggttgaagaagatgtatcttacatccggtcaagctttgatcttccaccaccgccgccaccatcatcttagacttatattttaatattactactttgattttcagccttgtattttggctatattactatggtatttgaacaatttattatttccttatttgcatggtttggttgaacaagtatcttatttgactatgtggattttataagttaatctatttatgattgttacttcatggtttttacttcatgttgtggttaatattttttatgaatgctgtatgaatgtttaagatatatttgcatactttaagtttaaatacacactttggctttttgttgatgccaaagggggagagaaatagggataaatcaagaactcacatgagtaaataatttaattttaagataagcataaattcaaaaacaaagggggagcatttataagagtgatcgactaggaaaaagtgtgtgtgtgtttcttgatttctgaagttgtcatcataaaaaagggggagattgtggaagcaaagcttcatgatgaatcaacaatgattcaaaggtgttttgatgataacaatgatgacaacaaaagatgatgacaaaggtgatgaacaaaaagctcaaaagatcaaagaaaaactcaagtgaatcaaagaacatctcaagtgaatcaagaacaagtcaagagttcaagaatcaagaagaattcaagactcaagaagaaagcctacaatcaagaatcaagattcaagatgcaagatctcaagaatcaagatcaagattcaagactcaagattcaagaataaagaaaggactcaatcaagataagtattaaaaagtttttcaaaactttgaacagcacatgagtttttgacaaaacctttaccaaagagtttttactctctggtaatcgattaccatattgttgtaatcgattaccagtaggaaaatgagtttgaaaaagttttcaaactgaatttacaacgttccaaatattttcaaaaggctgtaatcgattacaatgttttggtaatcgattaccagtgtccttgaacgttgaaattcaaatttaaaagtgaagagtcacattgtttcactcaaaagctttgtgtaatcgattacacatatttggtaatcgattaccagtgtttgtttttgaaaaatctaaagatgtaactcttcaaaaaggttttgactttttcaaatgggttttaagtttttctaaaaagttataactcttctgaatggccttcttgaccagacatcaagagtttataaaagcaaggctttgttttgcattccgaatcaatctttccaacaacaatcttgaacaattattcatacaatcctttacaagccttgaatctctttgaacttcttcttcttctttgtaccaaaagctttctgaagttttttggttttctaaaccttgaaaacctgtgctattcatccttttcattctcttctccctttgccattcgccaaggattaatcgcctgaattctttttgtgtctctcttctcccttttcctaaagaaaaaaggactaaccgcctgaattcttttgtgtctcccttctcccttgtcaaagaattcaaaatgacacagtctgagaattcttttgattcttcccattccctaatacaaaagcgttcaaaggtttaaccgcctgagaattcttttgtatccccattcacaaagtatcaaaggtttaacagcctgagatctttgtcttaacacattggagggtacatcctttgtggtacaagtagagggtacatctacttgggtttgactgagaacaagagagggtacatctcttgtggattagttctagtggagggtacatccactagggtttcaaagagaacaagggagggtacatcccttgtggatctttgcttgtaaaaggatttttacaaggttgaaagaaatctcaaggaccccaggtcgcttgaggactggaggtaggcacgggttgttgccgaaccagtataaaaactcttgtgtgtttgtttccttcttccctactcttttactttccgttgtgcatttaattttcgcttttactttctgttaagtttctcttctactccatattctcttaacaacaaaagtaaaagccttaaaagagtaatttttaattggtaaagttttaggaataattaattcaaccctcccttcttaattattctgaggccactcgatccaacaccatcaacattcgcctatgaaggataaataggggtgtcacaaagaagaaacaatggtcggtattatgatatcttcaaaaaatagatctaggtttcccatgtgcacgatgttgtcactcgctgcttctaacaaaaatgtcggaaaggtatttcatggccattgtctactcccactactagaaaatatacttttaaaatcgctaggctaacatcatttttcgatacaatcgatgttaatgaaaacacgatggcataatcataaataacatgaattcgttgacatcggttttttcaaaaaccgatgtgagttcgttaacatcagttttttagaaatcaatgttaatgaacttttgttaacatcattttttttgaaaaattgttgttaacaaaacgcgttaacattgatttttggaaaaaaccaacgttgtgctatcctatttataattttctttcgtgcttctcactctcactctctctgtccatggcgcttcagtctcgctctcactctcacccttcaccagagctctcactctcaccctcgtgacagtcctctccttcgcgaaggtcctcgtgctcagtctcaccaccatcactcgcgaaggttgtaacaccctgatatatatattattagtaattatatttgatgtttgattattttgttgtgttatttgactacatgatagacttgaatgagttgaactatgcccttgaactagtcatgtgtgaatttcttgatatggatgttgaattatgtggagttttgttgagctaagttgaaagtatgagattttagattttaccaaaacctagttcaatgaaatcgcgacaccagattcgttaactgttgcatcatcttcaaattttgtctggatatccctaagatatgttcctactgtctgaccgttgggatcttgaaaataataacttttagtctcccgctaagcgagaaaggcacgctaagcgcaattccaaccgaggggaattgtgctgagcggcccaaagctgcactaagcccatttccaaccgagaggaagtgcactgagcgcccagaaggcccgctaagcaaatgttgcaggttataaatacgtccttagcgtgaaaaacacaatttcactcacctcttcccccaaaaacgtctcccaaaccctaaaaccttattttccaccacccaagaccaccagtggccgctatgagccgctgttgcttgccgttggacccccacaccaagaggaacactttaatcagagcagaatcctcagaattcggtggagaaaatccctcaatcctccatttcaaagtttctctaaggtaaccttgacttctaagccttctcctagctagtttgagttcctcttagtgtctcttatgtgttgggtactgttatagggtgtttttacacttcctttgaaaaatcctagagaatgagacattgtaaaagttatctttttatgaccttgaggttatttttgcggcattcactaaaccccggtcacattggcgtgatcggaatttcaaaaagatgtttcttttctgtagaacccgaaatacccctctatcccttatgttttgacagtggtatttgaccccgaatgtttcctttgatcttgtttttgaagcctatgctaaattccttttgttttggtgtaatagagacttgcgttggactgacaagcgtgaacgagagagagacctctaagtgatgcaaagagaaactgacggagagctcacgataggtgaggggagttattataaaatttactattttgacaccatagttagggtcagggaacctagctctgagaatatctgcatgtccctattgcatgctgattttctttcaagaaaaactatgtttttaacgaatgggatgcgatatatctattgtggatgaatgacataatattcatgtattcggtcaaacattggtgcgtgtttggggacaatatatatatatatatatatatatatatatatatatatatatatatatatatatatatatatatatatatatttgtgaaattcaaatattactatgattttcataagtaaaaataatggagttttcataaaagaaagaaaaagaatttaatttttcagttattagagtggtgatatcgtaacgacgaggcgggtcattacaaaggtgctcccgcgttctactgtaacaccgtcactgcctcacccatgttttgctgcgacctcgtcattgttttgtattatctctaccttgcgacttgaagccttctttggtttcatgtccaattccctcgtgacttcctccccaggttagtacctgaaaatgtgttcattgagaaatgcttttgctttatgtctaaaatgtgctctttgttcttgaaaatgtgcgatgtttggtgtattaactgactcatattcgtactgaaagtgtgctctctattcctaacacgaaacatggtccaaaaaggttttaagctaagctagttgaagaagctgaatcttatgattctttaatcttaatcacaaattttgtatctctgtcatatcatatccatagttcgggaatactaagcttggggatgattggtatcaatgtgtagtacctttgtattgtcttcgtgggtggaaaatgtgttcattgggtttggttttttttttgtactcgtggggttttaagcccaacttgataattcatgtgaacttctcaatctaagtttaaattaagctgtgaatgatccttgtttgtttttttttttgcttaccgatggactcaaaggtagtttgggtacataatggattaatattgtggggtttgagttataggttaatttagttgttgtgggtctcaggcccaagttaataatcaccttgtatttgcatttttatatattggattcaattgtgggatcttattgatgctaagcgacttttttctttattaggaatattgtttcttgttttttaaaaataaagatggttgtgtaaccgtcaatttaagcgagtaaaaactcttacacccatcttttaatgaaaaattttgtttttaccaatttaattcagacttttaatttacactatctttgtattagtgtaggctccaagattagaattagtagttgtatttatagatgtattgattggtcattgactaaattggattagtcattacttgttattaatttaattatatataaattacgattctgttagtgtgtgaaatttcttttctttgattttattcattgcagattcttgaaacatattaaatctattttgttcttgttccttctttatataatgatgtaagctccattggagcttgtaggcctaggaagatgaatgacagcggaatggagaaggaaaagagaaagaagatgccacttcaaggagaagatgagtctagaagaagctcacaaccataggaggccatggataagagcttggaggaagaaagagatgaatgaagggagaggaagagaagagcacaaaatttttgtgctctaaaagagctctgaaatctgaagtttaattttcaaatgatcaaagttaaaaaaatgcacacacatgacctctatttatagcccaagtgtcacacaaaattggagggaaattcaaatttcacttgaatttatggagccaaattttggagccaaaacttcactaattataattagtgaattgcagttatggttcagcccactaatccaagatcaattccaagattcgccactaattgtgcttaggtgtcatgaggcatgtaaagcatgaaggacatgcacaaagtatgactatatgatgtggcaatggggtgtagtaagcaaatgctcacctccccctctaaaatttaattggattgggcttctaccaattcaattaaatttatttctcaacacacacatcaaatattcacttagtgaatgtgaaattacaaaactacccataatacaaaaactagtctaggtgccataaaatacaagggttgaaaaatcctatatttctagggtatcctacctacattatggagccctaaatacaaggaccaagtataatgacatcctaatctaatatgtacaaagataattggacccaaccttggcccatgggctcagaaatctaccttaaggttcatgagaaccctagggccttcttcagcagctctagcccaatcctcttggagcctcttgctcatggctctagtgactggtcccttcctagggaggattgcatcattccctcccccttgaagaggatttgaccttaaatctgttagttcctcctcctcaatatcagctccaccttcaaaaggaattaaatcaaaaatgttaaaagtggtgttgactccatactcttctaggaggtccaacctataggcattgttattgatcctctccaaaacctggaaaggtccatcccctctagggctaagcttgagtattctatagtgtcacctaaatagcttggc

SEQ ID NO: 247 - protein, 10 aa, Glycine Max
  misc_feature (4)..(5): Xaa can be any naturally occurring amino acid
  misc_feature (7)..(7): Xaa can be any naturally occurring amino acid
  misc_feature (9)..(10): Xaa can be any naturally occurring amino acid
LRRXXLXLXX

What is claimed is

1. An isolated nucleic acid molecule that encodes a polypeptide having *Phytophthora* resistance activity, said nucleic acid molecule is selected from the group consisting of:

(a) a nucleic acid molecule comprising the sequence set forth in SEQ ID NO: 246 from position 18,019 to position 21,708;

(b) a nucleic acid molecule comprising a sequence having at least 95% sequence identity to the nucleotide sequence set forth in (a); and (c) a full length complement of the sequence set forth in (a).

2. A vector comprising the nucleic acid molecule of claim 1.

3. A plant cell having stably incorporated in its genome the nucleic acid molecule of claim 1.

4. The plant cell of claim 3, wherein said plant cell is from a dicot plant.

5. The plant cell of claim 4, wherein said dicot plant is soybean.

6. A plant having stably incorporated into its genome the nucleic acid molecule of claim 1.

7. A method for conferring *Phytophthora* resistance in a plant comprising:

transforming a plant cell with the nucleic acid molecule of claim 1; and regenerating a plant from the transformed plant cell, thereby conferring *Phytophthora* resistance in a plant.

8. The method of claim 7, wherein said plant is a dicot.

9. The method of claim 8, wherein said dicot is soybean.

10. The method of claim 7, wherein said nucleic acid molecule is in a vector for over-expression of the sequence set forth in SEQ ID NO: 246 from position 18,019 to position 21,708.

11. The plant of claim 7, wherein said promoter is a constitutive promoter.

12. The plant of claim 7, wherein said promoter is a tissue-preferred promoter.

13. The plant of claim 7, wherein said promoter is an inducible promoter.

* * * * *